US009840554B2

(12) United States Patent
Gu et al.

(10) Patent No.: US 9,840,554 B2
(45) Date of Patent: Dec. 12, 2017

(54) ANTIBODIES AGAINST PLATELET-DERIVED GROWTH FACTOR (PDGF)

(71) Applicant: ABBVIE INC., North Chicago, IL (US)

(72) Inventors: Jijie Gu, Shrewsbury, MA (US); Diana Bowley, Shrewsbury, MA (US); Lucia Eaton, Grafton, MA (US); Feng Dong, Lansdale, PA (US); Lorenzo Benatuil, Northborough, MA (US); Tariq Ghayur, Holliston, MA (US); Ravi Chari, Worcester, MA (US); Matthew Rieser, Sugar Grove, IL (US); Anca Clabbers, Rutland, MA (US)

(73) Assignee: AbbVie Inc., North Chicago, IL (US)

( * ) Notice: Subject to any disclaimer, the term of this patent is extended or adjusted under 35 U.S.C. 154(b) by 0 days.

(21) Appl. No.: 15/183,725

(22) Filed: Jun. 15, 2016

(65) Prior Publication Data
US 2017/0015742 A1    Jan. 19, 2017

Related U.S. Application Data

(60) Provisional application No. 62/291,964, filed on Feb. 5, 2016, provisional application No. 62/175,546, filed on Jun. 15, 2015.

(51) Int. Cl.
| C07K 16/22 | (2006.01) |
| C07K 16/24 | (2006.01) |
| A61K 39/395 | (2006.01) |
| A61K 45/06 | (2006.01) |
| C07K 16/46 | (2006.01) |
| C07K 14/00 | (2006.01) |
| A61K 39/00 | (2006.01) |

(52) U.S. Cl.
CPC .......... *C07K 16/22* (2013.01); *A61K 39/3955* (2013.01); *A61K 45/06* (2013.01); *C07K 14/00* (2013.01); *C07K 16/24* (2013.01); *C07K 16/468* (2013.01); *A61K 2039/505* (2013.01); *C07K 2317/24* (2013.01); *C07K 2317/31* (2013.01); *C07K 2317/33* (2013.01); *C07K 2317/51* (2013.01); *C07K 2317/52* (2013.01); *C07K 2317/56* (2013.01); *C07K 2317/565* (2013.01); *C07K 2317/64* (2013.01); *C07K 2317/76* (2013.01); *C07K 2317/92* (2013.01); *C07K 2317/94* (2013.01)

(58) Field of Classification Search
CPC ...... C07K 16/22; C07K 16/24; C07K 16/468; C07K 2317/24; C07K 2317/31; C07K 2317/33; C07K 2317/51; C07K 2317/52; C07K 2317/56; C07K 2317/565; C07K 2317/64; C07K 2317/76; C07K 2317/92; C07K 2317/94; A61K 45/06; A61K 39/3955; A61K 2039/505
See application file for complete search history.

(56) References Cited

U.S. PATENT DOCUMENTS

| 4,526,938 A | 7/1985 | Churchill et al. |
| 4,554,101 A | 11/1985 | Hopp |
| 4,699,784 A | 10/1987 | Shih et al. |
| 4,753,894 A | 6/1988 | Frankel et al. |
| 4,816,567 A | 3/1989 | Cabilly et al. |
| 4,880,780 A | 11/1989 | Trainor et al. |
| 4,943,533 A | 7/1990 | Mendelsohn et al. |
| 4,946,778 A | 8/1990 | Ladner et al. |
| 4,980,286 A | 12/1990 | Morgan et al. |
| 5,006,309 A | 4/1991 | Khalil et al. |
| 5,063,081 A | 11/1991 | Cozzette et al. |
| 5,089,424 A | 2/1992 | Khalil et al. |
| 5,128,326 A | 7/1992 | Balazs et al. |
| 5,223,409 A | 6/1993 | Ladner et al. |
| 5,225,539 A | 7/1993 | Winter |
| 5,258,498 A | 11/1993 | Huston et al. |
| 5,290,540 A | 3/1994 | Prince et al. |
| 5,294,404 A | 3/1994 | Grandone et al. |
| 5,403,484 A | 4/1995 | Ladner et al. |
| 5,427,908 A | 6/1995 | Dower et al. |
| 5,500,362 A | 3/1996 | Robinson et al. |
| 5,516,637 A | 5/1996 | Huang et al. |
| 5,530,101 A | 6/1996 | Queen et al. |
| 5,558,864 A | 9/1996 | Bendig et al. |
| 5,565,332 A | 10/1996 | Hoogenboom et al. |
| 5,565,352 A | 10/1996 | Hochstrasser et al. |

(Continued)

FOREIGN PATENT DOCUMENTS

| CN | 1276428 A | 12/2000 |
| CN | 101058609 A | 10/2007 |

(Continued)

OTHER PUBLICATIONS

Heldin CH. Targeting the PDGFsignaling pathway in tumor treatment. Cell. Commun. Signal. 11(97). 18 pages. Dec. 20, 2013.*
Fiala M, et al. IL-17A is increased in the serum and in spinal cord CD8 and mast cells of ALS patients. J. Neuroinflamm. 7(76). 14 pages. Nov. 9, 2010.*
"Adalimumab," in *The Merck Index*. 14th Ed., John Wiley & Sons, 2006; pp. 26-27.
"Cetuximab," in *The Merck Index*. 14th Ed., John Wiley & Sons, 2006; p. 335.
"Infliximab," in *The Merck Index*. 14th Ed., John Wiley & Sons, 2006; p. 863.
"Rituximab," in *The Merck Index*. 14th Ed., John Wiley & Sons, 2006; p. 1422.

(Continued)

*Primary Examiner* — Robert Landsman
(74) *Attorney, Agent, or Firm* — Finnegan, Henderson, Farabow, Garrett & Dunner, LLP

(57) ABSTRACT

Binding proteins that bind one or more of VEGF, PDGF and/or their receptors, including antibodies, CDR-grafted antibodies, humanized antibodies, binding fragments, fusion proteins, and bispecific or multispecific proteins thereof are disclosed. Also disclosed are methods of making and using the binding proteins.

9 Claims, 7 Drawing Sheets

(56) References Cited

U.S. PATENT DOCUMENTS

| | | |
|---|---|---|
| 5,571,698 A | 11/1996 | Ladner et al. |
| 5,580,717 A | 12/1996 | Dower et al. |
| 5,585,089 A | 12/1996 | Queen et al. |
| 5,624,821 A | 4/1997 | Winter et al. |
| 5,627,052 A | 5/1997 | Schrader |
| 5,641,870 A | 6/1997 | Rinderknecht et al. |
| 5,648,260 A | 7/1997 | Winter et al. |
| 5,656,272 A | 8/1997 | Le et al. |
| 5,658,727 A | 8/1997 | Barbas et al. |
| 5,677,171 A | 10/1997 | Hudziak et al. |
| 5,679,377 A | 10/1997 | Bernstein et al. |
| 5,693,762 A | 12/1997 | Queen et al. |
| 5,698,426 A | 12/1997 | Huse |
| 5,714,350 A | 2/1998 | Co et al. |
| 5,714,352 A | 2/1998 | Jakobovits |
| 5,723,323 A | 3/1998 | Kauffman et al. |
| 5,733,743 A | 3/1998 | Johnson et al. |
| 5,736,137 A | 4/1998 | Anderson et al. |
| 5,750,753 A | 5/1998 | Kimae et al. |
| 5,763,192 A | 6/1998 | Kauffman et al. |
| 5,766,886 A | 6/1998 | Studnicka et al. |
| 5,776,456 A | 7/1998 | Anderson et al. |
| 5,780,225 A | 7/1998 | Wigler et al. |
| 5,789,554 A | 8/1998 | Leung et al. |
| 5,795,965 A | 8/1998 | Tsuchiya et al. |
| 5,814,476 A | 9/1998 | Kauffman et al. |
| 5,817,483 A | 10/1998 | Kauffman et al. |
| 5,821,047 A | 10/1998 | Garrard et al. |
| 5,824,514 A | 10/1998 | Kauffman et al. |
| 5,846,765 A | 12/1998 | Matthews et al. |
| 5,849,500 A | 12/1998 | Breitling et al. |
| 5,855,913 A | 1/1999 | Hanes et al. |
| 5,863,765 A | 1/1999 | Berry et al. |
| 5,874,064 A | 2/1999 | Edwards et al. |
| 5,891,996 A | 4/1999 | Mateo de Acosta del Rio et al. |
| 5,912,015 A | 6/1999 | Bernstein et al. |
| 5,916,597 A | 6/1999 | Lee et al. |
| 5,916,771 A | 6/1999 | Hori et al. |
| 5,929,212 A | 7/1999 | Jolliffe et al. |
| 5,934,272 A | 8/1999 | Lloyd et al. |
| 5,939,598 A | 8/1999 | Kucherlapati et al. |
| 5,959,083 A | 9/1999 | Bosslet et al. |
| 5,969,108 A | 10/1999 | McCafferty et al. |
| 5,976,862 A | 11/1999 | Kauffman et al. |
| 5,985,309 A | 11/1999 | Edwards et al. |
| 5,985,320 A | 11/1999 | Edwards et al. |
| 5,985,588 A | 11/1999 | Breitling et al. |
| 5,985,615 A | 11/1999 | Jakobovits et al. |
| 5,989,463 A | 11/1999 | Tracy et al. |
| 5,989,830 A | 11/1999 | Davis et al. |
| 5,998,209 A | 12/1999 | Jokobovits et al. |
| 6,019,968 A | 2/2000 | Platz et al. |
| 6,054,297 A | 4/2000 | Carter et al. |
| 6,057,098 A | 5/2000 | Buechler et al. |
| 6,066,719 A | 5/2000 | Zapata |
| 6,075,181 A | 6/2000 | Kucherlapati et al. |
| 6,090,382 A | 7/2000 | Salfeld et al. |
| 6,091,001 A | 7/2000 | Jakobovits et al. |
| 6,114,598 A | 9/2000 | Kucherlapati et al. |
| 6,127,132 A | 10/2000 | Breitling et al. |
| 6,130,364 A | 10/2000 | Jakobovits et al. |
| 6,180,370 B1 | 1/2001 | Queen et al. |
| 6,204,023 B1 | 3/2001 | Robinson et al. |
| 6,214,984 B1 | 4/2001 | Zapata |
| 6,235,883 B1 | 5/2001 | Jakobovits et al. |
| 6,239,259 B1 | 5/2001 | Davis et al. |
| 6,258,562 B1 | 7/2001 | Salfeld et al. |
| 6,350,861 B1 | 2/2002 | Co et al. |
| 6,387,627 B1 | 5/2002 | Breitling et al. |
| 6,491,916 B1 | 12/2002 | Bluestone et al. |
| 6,506,883 B2 | 1/2003 | Meteo de Acosta del Rio et al. |
| 6,509,015 B1 | 1/2003 | Salfeld et al. |
| 6,639,055 B1 | 10/2003 | Carter et al. |
| 6,660,843 B1 | 12/2003 | Feige et al. |
| 6,699,473 B2 | 3/2004 | Raisch et al. |
| 6,699,658 B1 | 3/2004 | Wittrup et al. |
| 6,730,483 B2 | 5/2004 | Breitling et al. |
| 6,818,392 B2 | 11/2004 | Lou et al. |
| 6,884,879 B1 | 4/2005 | Baca et al. |
| 6,914,128 B1 | 7/2005 | Salfeld et al. |
| 6,986,890 B1 | 1/2006 | Shitara et al. |
| 7,060,269 B1 | 6/2006 | Baca et al. |
| 7,060,808 B1 | 6/2006 | Goldstein et al. |
| 7,070,775 B2 | 7/2006 | Le et al. |
| 7,070,959 B1 | 7/2006 | Papadopoulos et al. |
| 7,169,901 B2 | 1/2007 | Baca et al. |
| 7,179,892 B2 | 2/2007 | Basi et al. |
| 7,189,819 B2 | 3/2007 | Basi et al. |
| 7,202,343 B2 | 4/2007 | Gudas et al. |
| 7,241,733 B2 | 7/2007 | Heavner et al. |
| 7,247,301 B2 | 7/2007 | van de Winkel et al. |
| 7,247,304 B2 | 7/2007 | van de Winkel et al. |
| 7,258,857 B2 | 8/2007 | Stern et al. |
| 7,262,028 B2 | 8/2007 | Van Berkel et al. |
| 7,285,269 B2 | 10/2007 | Babcook et al. |
| 7,317,091 B2 | 1/2008 | Lazar et al. |
| 7,419,821 B2 | 9/2008 | Davis et al. |
| 7,429,486 B2 | 9/2008 | Van Berkel et al. |
| 7,438,911 B2 | 10/2008 | Shitara et al. |
| 7,446,175 B2 | 11/2008 | Gram et al. |
| 7,446,179 B2 | 11/2008 | Jensen et al. |
| 7,449,616 B2 | 11/2008 | Pons et al. |
| 7,491,516 B2 | 2/2009 | Collinson et al. |
| 7,528,236 B2 | 5/2009 | Fong et al. |
| 7,566,772 B2 | 7/2009 | Green et al. |
| 7,592,429 B2 | 9/2009 | Paszty et al. |
| 7,612,181 B2 | 11/2009 | Wu et al. |
| 7,682,833 B2 | 3/2010 | Miller et al. |
| 7,723,099 B2 | 5/2010 | Miller et al. |
| 7,727,527 B2 | 6/2010 | Shelton |
| 7,790,858 B2 | 9/2010 | Presta |
| 7,863,419 B2 | 1/2011 | Taylor et al. |
| 7,915,388 B2 | 3/2011 | Wu et al. |
| 7,928,205 B2 | 4/2011 | Dillon et al. |
| 8,187,836 B2 | 5/2012 | Hsieh |
| 8,258,268 B2 | 9/2012 | Wu et al. |
| 8,268,314 B2 | 9/2012 | Baehner et al. |
| 8,388,965 B2 | 3/2013 | Rao et al. |
| 8,389,237 B2 | 3/2013 | Skerry et al. |
| 8,420,783 B2 | 4/2013 | Goldenberg et al. |
| 8,455,219 B2 | 6/2013 | Hsieh |
| 8,586,714 B2 | 11/2013 | Ghayur et al. |
| 8,623,358 B2 | 1/2014 | Benatuil et al. |
| 8,624,002 B2 | 1/2014 | Gu et al. |
| 8,664,367 B2 | 3/2014 | Wu et al. |
| 8,716,450 B2 | 5/2014 | Ghayur et al. |
| 8,722,855 B2 | 5/2014 | Ghayur et al. |
| 8,735,546 B2 | 5/2014 | Ghayur et al. |
| 8,779,101 B2 | 7/2014 | Hsieh et al. |
| 8,822,645 B2 | 9/2014 | Ghayur et al. |
| 8,835,610 B2 | 9/2014 | Hsieh et al. |
| 8,841,417 B2 | 9/2014 | Wu et al. |
| 8,853,365 B2 | 10/2014 | Wu et al. |
| 8,858,941 B2 | 10/2014 | Gurney et al. |
| 8,889,130 B2 | 11/2014 | Kamath |
| 8,987,418 B2 | 3/2015 | Ghayur et al. |
| 9,029,508 B2 | 5/2015 | Ghayur et al. |
| 9,035,027 B2 | 5/2015 | Ghayur et al. |
| 9,045,551 B2 | 6/2015 | Gu et al. |
| 9,046,513 B2 | 6/2015 | Ghayur et al. |
| 9,062,108 B2 | 6/2015 | Ghayur et al. |
| 9,109,026 B2 | 8/2015 | Ghayur et al. |
| 9,115,195 B2 | 8/2015 | Chen et al. |
| 9,120,870 B2 | 9/2015 | Hsieh et al. |
| 9,132,190 B2 | 9/2015 | Benatuil et al. |
| 9,163,093 B2 | 10/2015 | Gu et al. |
| 2002/0004587 A1 | 1/2002 | Miller et al. |
| 2002/0127231 A1 | 9/2002 | Schneck et al. |
| 2002/0136719 A1 | 9/2002 | Shenoy et al. |
| 2002/0137134 A1 | 9/2002 | Gerngross |
| 2003/0039645 A1 | 2/2003 | Adair et al. |
| 2003/0091561 A1 | 5/2003 | van de Winkel et al. |
| 2003/0092059 A1 | 5/2003 | Salfeld et al. |
| 2003/0118583 A1 | 6/2003 | Emery et al. |

(56) References Cited

U.S. PATENT DOCUMENTS

| | | |
|---|---|---|
| 2003/0165496 A1 | 9/2003 | Basi et al. |
| 2003/0186374 A1 | 10/2003 | Hufton et al. |
| 2003/0206898 A1 | 11/2003 | Fischkoff et al. |
| 2003/0226155 A1 | 12/2003 | Sadeghi et al. |
| 2004/0018577 A1 | 1/2004 | Emerson Campbell et al. |
| 2004/0018590 A1 | 1/2004 | Gerngross et al. |
| 2004/0038339 A1 | 2/2004 | Kufer et al. |
| 2004/0133357 A1 | 7/2004 | Zhong et al. |
| 2004/0162411 A1 | 8/2004 | Lanzavecchia |
| 2004/0219144 A1 | 11/2004 | Shelton |
| 2004/0237124 A1 | 11/2004 | Pons et al. |
| 2004/0241745 A1 | 12/2004 | Honjo et al. |
| 2005/0026881 A1 | 2/2005 | Robinson et al. |
| 2005/0038231 A1 | 2/2005 | Fahrner et al. |
| 2005/0042664 A1 | 2/2005 | Wu et al. |
| 2005/0095246 A1 | 5/2005 | Shafer |
| 2005/0118643 A1 | 6/2005 | Burgess et al. |
| 2005/0147610 A1 | 7/2005 | Ghayur et al. |
| 2005/0215769 A1 | 9/2005 | Breece et al. |
| 2005/0260204 A1 | 11/2005 | Allan |
| 2006/0002923 A1 | 1/2006 | Uede et al. |
| 2006/0024300 A1 | 2/2006 | Adams et al. |
| 2006/0041058 A1 | 2/2006 | Yin et al. |
| 2006/0067930 A1 | 3/2006 | Adams et al. |
| 2006/0073141 A1 | 4/2006 | Ignatovich et al. |
| 2006/0078967 A1 | 4/2006 | Medlock et al. |
| 2006/0093599 A1 | 5/2006 | Gazit-Bornstein et al. |
| 2006/0104968 A1 | 5/2006 | Bookbinder et al. |
| 2006/0134105 A1 | 6/2006 | Lazar et al. |
| 2006/0160164 A1 | 7/2006 | Miller et al. |
| 2006/0233791 A1 | 10/2006 | Tedder et al. |
| 2006/0246071 A1 | 11/2006 | Green et al. |
| 2006/0253100 A1 | 11/2006 | Burright et al. |
| 2006/0280747 A1 | 12/2006 | Fuh et al. |
| 2007/0041905 A1 | 2/2007 | Hoffman et al. |
| 2007/0042458 A1 | 2/2007 | DeFrees et al. |
| 2007/0071675 A1 | 3/2007 | Wu et al. |
| 2007/0071745 A1 | 3/2007 | Umana et al. |
| 2007/0072225 A1 | 3/2007 | Alving |
| 2007/0092507 A1 | 4/2007 | Balthasar et al. |
| 2007/0092520 A1 | 4/2007 | Dennis et al. |
| 2007/0110747 A1 | 5/2007 | Paszty et al. |
| 2007/0123479 A1 | 5/2007 | Kufer et al. |
| 2007/0196376 A1 | 8/2007 | Raeber et al. |
| 2007/0232556 A1 | 10/2007 | Montine et al. |
| 2007/0286858 A1 | 12/2007 | Clancy et al. |
| 2007/0292420 A1 | 12/2007 | Giles-Komar et al. |
| 2008/0014196 A1 | 1/2008 | Yan |
| 2008/0015194 A1 | 1/2008 | Errico et al. |
| 2008/0038257 A1 | 2/2008 | Han et al. |
| 2008/0112888 A1 | 5/2008 | Wang |
| 2008/0118506 A1 | 5/2008 | An et al. |
| 2008/0118978 A1 | 5/2008 | Sato et al. |
| 2008/0171014 A1 | 7/2008 | Wu et al. |
| 2008/0175847 A1 | 7/2008 | Yan et al. |
| 2008/0187966 A1 | 8/2008 | Simmons |
| 2008/0193455 A1 | 8/2008 | Stassen et al. |
| 2008/0219971 A1 | 9/2008 | Smith et al. |
| 2008/0241163 A1 | 10/2008 | Burkly et al. |
| 2009/0028851 A1 | 1/2009 | Stuhmer et al. |
| 2009/0030308 A1 | 1/2009 | Bradford et al. |
| 2009/0035308 A1 | 2/2009 | Gill et al. |
| 2009/0042214 A1 | 2/2009 | Cooke et al. |
| 2009/0048122 A1 | 2/2009 | Glaser et al. |
| 2009/0053243 A1 | 2/2009 | Kurosawa et al. |
| 2009/0068195 A1 | 3/2009 | Vugmeyster et al. |
| 2009/0081234 A1 | 3/2009 | Heavner et al. |
| 2009/0148513 A1 | 6/2009 | Fraunhofer et al. |
| 2009/0155257 A1 | 6/2009 | Adams et al. |
| 2009/0155275 A1 | 6/2009 | Wu et al. |
| 2009/0191225 A1 | 7/2009 | Chang et al. |
| 2009/0208490 A1 | 8/2009 | Pavone et al. |
| 2009/0215992 A1 | 8/2009 | Wu et al. |
| 2009/0239259 A1 | 9/2009 | Hsieh |
| 2009/0259026 A1 | 10/2009 | Tomlinson et al. |
| 2009/0304693 A1 | 12/2009 | Ghayur et al. |
| 2009/0311253 A1 | 12/2009 | Ghayur et al. |
| 2010/0028340 A1 | 2/2010 | Mueller et al. |
| 2010/0047239 A1 | 2/2010 | Wu et al. |
| 2010/0056762 A1 | 3/2010 | Old |
| 2010/0076178 A1 | 3/2010 | Ghayur et al. |
| 2010/0104573 A1 | 4/2010 | Burkly et al. |
| 2010/0105569 A1 | 4/2010 | Hsieh et al. |
| 2010/0158901 A1 | 6/2010 | Tedder et al. |
| 2010/0190247 A1 | 7/2010 | Lazar et al. |
| 2010/0210511 A1 | 8/2010 | Carvajal |
| 2010/0233079 A1 | 9/2010 | Jakob et al. |
| 2010/0260668 A1 | 10/2010 | Ghayur et al. |
| 2010/0266531 A1 | 10/2010 | Hsieh et al. |
| 2011/0008766 A1 | 1/2011 | Ghayur et al. |
| 2011/0044980 A1 | 2/2011 | Ghayur et al. |
| 2011/0091463 A1 | 4/2011 | Ghayur et al. |
| 2011/0142761 A1 | 6/2011 | Wu et al. |
| 2011/0150870 A1 | 6/2011 | Rader et al. |
| 2011/0217237 A1 | 9/2011 | Chen et al. |
| 2011/0229476 A1 | 9/2011 | Liu et al. |
| 2011/0263827 A1 | 10/2011 | Ghayur et al. |
| 2011/0318349 A1 | 12/2011 | Ghayur et al. |
| 2012/0014957 A1 | 1/2012 | Ghayur et al. |
| 2012/0087858 A1 | 4/2012 | Ghayur et al. |
| 2012/0201746 A1 | 8/2012 | Liu et al. |
| 2012/0258108 A1 | 10/2012 | Ghayur et al. |
| 2012/0263722 A1 | 10/2012 | Ghayur et al. |
| 2013/0004416 A1 | 1/2013 | Wu et al. |
| 2013/0164256 A1 | 6/2013 | Hsieh et al. |
| 2013/0171059 A1 | 7/2013 | Ghayur et al. |
| 2013/0171096 A1 | 7/2013 | Hsieh et al. |
| 2013/0195871 A1 | 8/2013 | Ghayur et al. |
| 2013/0236458 A1 | 9/2013 | Hsieh et al. |
| 2013/0344537 A1 | 12/2013 | Hsieh |
| 2014/0079705 A1 | 3/2014 | Hsieh et al. |
| 2014/0093521 A1 | 4/2014 | Benatuil et al. |
| 2014/0099671 A1 | 4/2014 | Wu et al. |
| 2014/0134171 A1 | 5/2014 | Ghayur et al. |
| 2014/0134172 A1 | 5/2014 | Gu et al. |
| 2014/0161804 A1 | 6/2014 | Cuff et al. |
| 2014/0161817 A1 | 6/2014 | Siedler et al. |
| 2014/0170152 A1 | 6/2014 | Hsieh et al. |
| 2014/0186377 A1 | 7/2014 | Gu et al. |
| 2014/0205562 A1 | 7/2014 | Wu et al. |
| 2014/0212379 A1 | 7/2014 | Wu et al. |
| 2014/0212423 A1 | 7/2014 | Hanzatian et al. |
| 2014/0212925 A1 | 7/2014 | Wu et al. |
| 2014/0213771 A1 | 7/2014 | Ghayur et al. |
| 2014/0213772 A1 | 7/2014 | Ghayur et al. |
| 2014/0219912 A1 | 8/2014 | Ghayur et al. |
| 2014/0219913 A1 | 8/2014 | Ghayur et al. |
| 2014/0220019 A1 | 8/2014 | Ghayur et al. |
| 2014/0220020 A1 | 8/2014 | Wu et al. |
| 2014/0221621 A1 | 8/2014 | Benatuil et al. |
| 2014/0221622 A1 | 8/2014 | Ghayur et al. |
| 2014/0234208 A1 | 8/2014 | Ghayur et al. |
| 2014/0235476 A1 | 8/2014 | Gu et al. |
| 2014/0243228 A1 | 8/2014 | Benatuil et al. |
| 2014/0271457 A1 | 9/2014 | Ghayur et al. |
| 2014/0271458 A1 | 9/2014 | Ghayur et al. |
| 2014/0295497 A1 | 10/2014 | Hartman et al. |
| 2014/0308286 A1 | 10/2014 | Ghayur et al. |
| 2014/0335014 A1 | 11/2014 | Ghayur et al. |
| 2014/0335564 A1 | 11/2014 | Hsieh et al. |
| 2014/0343267 A1 | 11/2014 | Hsieh et al. |
| 2014/0348834 A1 | 11/2014 | Hsieh et al. |
| 2014/0348835 A1 | 11/2014 | Gu et al. |
| 2014/0348838 A1 | 11/2014 | Tarcsa |
| 2014/0348856 A1 | 11/2014 | Hsieh et al. |
| 2014/0356281 A1 | 12/2014 | Ghayur et al. |
| 2014/0356909 A1 | 12/2014 | Hsieh et al. |
| 2015/0017095 A1 | 1/2015 | Ghayur et al. |
| 2015/0017168 A1 | 1/2015 | Ghayur et al. |
| 2015/0050238 A1 | 2/2015 | Kamath |
| 2015/0104452 A1 | 4/2015 | Ghayur et al. |
| 2015/0183867 A1 | 7/2015 | Ghayur et al. |
| 2015/0232550 A1 | 8/2015 | Ghayur et al. |
| 2015/0291689 A1 | 10/2015 | Padley et al. |

(56) References Cited

U.S. PATENT DOCUMENTS

| | | |
|---|---|---|
| 2015/0315283 A1 | 11/2015 | Ghayur et al. |
| 2015/0344566 A1 | 12/2015 | Hsieh et al. |
| 2015/0344590 A1 | 12/2015 | Ghayur et al. |
| 2016/0002343 A1 | 1/2016 | Hanzatian et al. |
| 2016/0031986 A1 | 2/2016 | Chen et al. |
| 2016/0032000 A1 | 2/2016 | Ghayur et al. |
| 2016/0046730 A1 | 2/2016 | Ghayur et al. |
| 2016/0060332 A1 | 3/2016 | Benatuil et al. |
| 2016/0122439 A1 | 5/2016 | Gu et al. |
| 2016/0200813 A1 | 7/2016 | Benatuil et al. |
| 2016/0280791 A1 | 9/2016 | Ghayur et al. |
| 2016/0319026 A1 | 11/2016 | Ghayur et al. |

FOREIGN PATENT DOCUMENTS

| | | |
|---|---|---|
| EP | 0 148 075 A2 | 7/1985 |
| EP | 0 517 024 A2 | 12/1992 |
| EP | 0 592 106 A1 | 4/1994 |
| EP | 0 239 400 B1 | 8/1994 |
| EP | 1 176 195 A1 | 1/2002 |
| EP | 1 454 917 A2 | 9/2004 |
| EP | 0 592 106 B1 | 11/2004 |
| EP | 0 519 596 B1 | 2/2005 |
| RU | 2 273 664 C2 | 4/2006 |
| WO | WO 89/06692 A1 | 7/1989 |
| WO | WO 90/02809 A1 | 3/1990 |
| WO | WO 90/05144 A1 | 5/1990 |
| WO | WO 90/05183 A1 | 5/1990 |
| WO | WO 90/14424 A1 | 11/1990 |
| WO | WO 90/14430 A1 | 11/1990 |
| WO | WO 90/14443 A1 | 11/1990 |
| WO | WO 91/05548 A1 | 5/1991 |
| WO | WO 91/09967 A1 | 7/1991 |
| WO | WO 91/10737 A1 | 7/1991 |
| WO | WO 91/10741 A1 | 7/1991 |
| WO | WO 91/17271 A1 | 11/1991 |
| WO | WO 91/18983 A1 | 12/1991 |
| WO | WO 92/01047 A1 | 1/1992 |
| WO | WO 92/02551 A1 | 2/1992 |
| WO | WO 92/03461 A1 | 3/1992 |
| WO | WO 92/09690 A2 | 6/1992 |
| WO | WO 92/11272 A1 | 7/1992 |
| WO | WO 92/15679 A1 | 9/1992 |
| WO | WO 92/16553 A1 | 10/1992 |
| WO | WO 92/18619 A1 | 10/1992 |
| WO | WO 92/19244 A2 | 11/1992 |
| WO | WO 92/20791 A1 | 11/1992 |
| WO | WO 92/22324 A1 | 12/1992 |
| WO | WO 92/22653 A1 | 12/1992 |
| WO | WO 93/01288 A1 | 1/1993 |
| WO | WO 93/06213 A1 | 4/1993 |
| WO | WO 93/11161 A1 | 6/1993 |
| WO | WO 93/11236 A1 | 6/1993 |
| WO | WO 94/02602 A1 | 2/1994 |
| WO | WO 94/11026 A1 | 5/1994 |
| WO | WO 94/18219 A1 | 8/1994 |
| WO | WO 95/01997 A1 | 1/1995 |
| WO | WO 95/09917 A1 | 4/1995 |
| WO | WO 95/14780 A2 | 6/1995 |
| WO | WO 95/15982 A2 | 6/1995 |
| WO | WO 95/16026 A1 | 6/1995 |
| WO | WO 95/20045 A1 | 7/1995 |
| WO | WO 95/20401 A1 | 8/1995 |
| WO | WO 95/24918 A1 | 9/1995 |
| WO | WO 95/25167 A1 | 9/1995 |
| WO | WO 96/20698 A2 | 7/1996 |
| WO | WO 96/33735 A1 | 10/1996 |
| WO | WO 96/34096 A1 | 10/1996 |
| WO | WO 96/40210 A1 | 12/1996 |
| WO | WO 97/20032 A1 | 6/1997 |
| WO | WO 97/29131 A1 | 8/1997 |
| WO | WO 97/32572 A2 | 9/1997 |
| WO | WO 97/44013 A1 | 11/1997 |
| WO | WO 98/16654 A1 | 4/1998 |
| WO | WO 98/24893 A2 | 6/1998 |
| WO | WO 98/31346 A1 | 7/1998 |
| WO | WO 98/31700 A1 | 7/1998 |
| WO | WO 98/45331 A2 | 10/1998 |
| WO | WO 98/50433 A2 | 11/1998 |
| WO | WO 99/06834 A2 | 2/1999 |
| WO | WO 99/15154 A1 | 4/1999 |
| WO | WO 99/20253 A1 | 4/1999 |
| WO | WO 99/23221 A2 | 5/1999 |
| WO | WO 99/45031 A2 | 9/1999 |
| WO | WO 99/53049 A1 | 10/1999 |
| WO | WO 99/54342 A1 | 10/1999 |
| WO | WO 99/57134 A1 | 11/1999 |
| WO | WO 99/66903 A2 | 12/1999 |
| WO | WO 2000/09560 A2 | 2/2000 |
| WO | WO 2000/37504 A2 | 6/2000 |
| WO | WO 2000/56772 A1 | 9/2000 |
| WO | WO 2000/78815 A1 | 12/2000 |
| WO | WO 2001/00244 A2 | 1/2001 |
| WO | WO 2001/32712 A2 | 5/2001 |
| WO | WO 2001/58956 A2 | 8/2001 |
| WO | WO 2001/62300 A2 | 8/2001 |
| WO | WO 2001/62931 A2 | 8/2001 |
| WO | WO 2001/71005 A2 | 9/2001 |
| WO | WO 2001/77342 A1 | 10/2001 |
| WO | WO 2001/83525 A2 | 11/2001 |
| WO | WO 2001/88138 A1 | 11/2001 |
| WO | WO 2002/02773 A2 | 1/2002 |
| WO | WO 2002/02781 A1 | 1/2002 |
| WO | WO 2002/12502 A2 | 2/2002 |
| WO | WO 2002/16436 A2 | 2/2002 |
| WO | WO 2002/053596 A2 | 7/2002 |
| WO | WO 2002/072636 A2 | 9/2002 |
| WO | WO 2002/097048 A2 | 12/2002 |
| WO | WO 2003/016466 A2 | 2/2003 |
| WO | WO 2003/035835 A2 | 5/2003 |
| WO | WO 2003/039486 A2 | 5/2003 |
| WO | WO 2003/068801 A2 | 8/2003 |
| WO | WO 2003/086458 A1 | 10/2003 |
| WO | WO 2003/089614 A2 | 10/2003 |
| WO | WO 2003/100008 A2 | 12/2003 |
| WO | WO 2003/102132 A2 | 12/2003 |
| WO | WO 2004/003019 A2 | 1/2004 |
| WO | WO 2004/016286 A2 | 2/2004 |
| WO | WO 2004/024866 A2 | 3/2004 |
| WO | WO 2004/050683 A2 | 6/2004 |
| WO | WO 2004/058184 A2 | 7/2004 |
| WO | WO 2004/078140 A2 | 9/2004 |
| WO | WO 2005/016970 A2 | 2/2005 |
| WO | WO 2005/017107 A2 | 2/2005 |
| WO | WO 2005/044853 A2 | 5/2005 |
| WO | WO 2005/061540 A2 | 7/2005 |
| WO | WO 2005/061547 A2 | 7/2005 |
| WO | WO 2005/070965 A2 | 8/2005 |
| WO | WO 2005/087812 A1 | 9/2005 |
| WO | WO 2005/100584 A2 | 10/2005 |
| WO | WO 2005/118635 A2 | 12/2005 |
| WO | WO 2005/120557 A2 | 12/2005 |
| WO | WO 2006/001965 A2 | 1/2006 |
| WO | WO 2006/013107 A1 | 2/2006 |
| WO | WO 2006/015373 A2 | 2/2006 |
| WO | WO 2006/020258 A2 | 2/2006 |
| WO | WO 2006/024867 A2 | 3/2006 |
| WO | WO 2006/031370 A2 | 3/2006 |
| WO | WO 2006/044908 A2 | 4/2006 |
| WO | WO 2006/047350 A2 | 5/2006 |
| WO | WO 2006/066171 A1 | 6/2006 |
| WO | WO 2006/089133 A2 | 8/2006 |
| WO | WO 2006/099698 A2 | 9/2006 |
| WO | WO 2006/110883 A2 | 10/2006 |
| WO | WO 2006/116269 A2 | 11/2006 |
| WO | WO 2006/122187 A2 | 11/2006 |
| WO | WO 2006/130374 A2 | 12/2006 |
| WO | WO 2006/130429 A2 | 12/2006 |
| WO | WO 2006/131951 A2 | 12/2006 |
| WO | WO 2006/136159 A2 | 12/2006 |
| WO | WO 2007/005955 A2 | 1/2007 |
| WO | WO 2007/024715 A9 | 3/2007 |
| WO | WO 2007/042261 A2 | 4/2007 |
| WO | WO 2007/048849 A1 | 5/2007 |

(56) References Cited

FOREIGN PATENT DOCUMENTS

| | | |
|---|---|---|
| WO | WO 2007/053447 A2 | 5/2007 |
| WO | WO 2007/056470 A2 | 5/2007 |
| WO | WO 2007/059136 A2 | 5/2007 |
| WO | WO 2007/062037 A2 | 5/2007 |
| WO | WO 2007/062852 A2 | 6/2007 |
| WO | WO 2007/077028 A2 | 7/2007 |
| WO | WO 2007/098417 A2 | 8/2007 |
| WO | WO 2007/117749 A2 | 10/2007 |
| WO | WO 2007/120651 A2 | 10/2007 |
| WO | WO 2007/120828 A1 | 10/2007 |
| WO | WO 2007/124299 A2 | 11/2007 |
| WO | WO 2007/143098 A2 | 12/2007 |
| WO | WO 2007/147901 A1 | 12/2007 |
| WO | WO 2008/011348 A2 | 1/2008 |
| WO | WO 2008/022152 A2 | 2/2008 |
| WO | WO 2008/024188 A2 | 2/2008 |
| WO | WO 2008/042236 A2 | 4/2008 |
| WO | WO 2008/057240 A2 | 5/2008 |
| WO | WO 2008/079326 A2 | 7/2008 |
| WO | WO 2008/100624 A2 | 8/2008 |
| WO | WO 2008/145338 A2 | 12/2008 |
| WO | WO 2008/150841 A1 | 12/2008 |
| WO | WO 2009/020654 A1 | 2/2009 |
| WO | WO 2009/052400 A1 | 4/2009 |
| WO | WO 2009/077993 A2 | 6/2009 |
| WO | WO 2009/089004 A1 | 7/2009 |
| WO | WO 2009/091912 A2 | 7/2009 |
| WO | WO 2009/134776 A2 | 11/2009 |
| WO | WO 2009/136382 A2 | 11/2009 |
| WO | WO 2009/149185 A2 | 12/2009 |
| WO | WO 2009/149189 A2 | 12/2009 |
| WO | WO 2009/155324 A2 | 12/2009 |
| WO | WO 2010/006060 A2 | 1/2010 |
| WO | WO 2010/040508 A1 | 4/2010 |
| WO | WO 2010/065882 A1 | 6/2010 |
| WO | WO 2010/096434 A2 | 8/2010 |
| WO | WO 2010/102251 A2 | 9/2010 |
| WO | WO 2011/039370 A1 | 4/2011 |
| WO | WO 2011/084714 A2 | 7/2011 |
| WO | WO 2011/091304 A1 | 7/2011 |
| WO | WO 2011/143562 A2 | 11/2011 |
| WO | WO 2012/061374 A2 | 5/2012 |
| WO | WO 2012/075037 A1 | 6/2012 |
| WO | WO 2012/088302 A2 | 6/2012 |
| WO | WO 2012/143379 A1 | 10/2012 |
| WO | WO 2013/112922 A1 | 8/2013 |
| WO | WO 2013/177062 A2 | 11/2013 |
| WO | WO 2014/033074 A2 | 3/2014 |
| WO | WO 2014/089209 A2 | 6/2014 |
| WO | WO 2014/151910 A1 | 9/2014 |
| WO | WO 2015/014884 A1 | 2/2015 |

OTHER PUBLICATIONS

"Trastuzumab," in *The Merck Index*. 14th Ed., John Wiley & Sons, 2006; p. 1646.
Ahmed et al., "Pharmacokinetics of ABT-122, a Dual TNF- and IL-17A-Targeted DVD-IG™, After Single Dosing in Healthy Volunteers and Multiple Dosing in Subjects with Rheumatoid Arthritis," *Ann. Rheum. Dis.*, 74(Suppl. 2):479, Abstract FRI0156 (2015).
Alderson et al., "Regulation of apoptosis and T cell activation by Fas-specific mAb," *Int. Immunol.*, 6(11): 1799-1806 (1994).
Alegre et al., "An Anti-Murine CD3 Monoclonal Antibody with a Low Affinity for Fcγ Receptors Suppresses Transplantation Responses While Minimizing Acute Toxicity and Immunogenicity," *J. Immunol.*, 155: 1544-1555 (1995).
Alt et al., "Novel tetravalent and bispecific IgG-like antibody molecules combining single-chain diabodies with the immunoglobulin g1 Fc or CH3 region," *FEBS Letters*, 454: 90-94 (1999).
Altschul et al., "Basic Local Alignment Search Tool," *J. Mol. Biol.*, 215: 403-410 (1990).
Altschul et al., "Gapped BLAST and PSI-BLAST: a new generation of protein database search programs," *Nucl. Acids Res.*, 25(17): 3389-3402 (1997).

Ames et al., "Conversion of murine Fabs isolated from a combinatorial phage display library to full length immunoglobulins," *J. Immunol. Methods*, 184: 177-186 (1995).
Andrew et al., "Fragmentation of Immunoglobulin G," *Current Protocols in Cell Biology*, 16.4.1-16.4.10 (2000).
Andrew et al., "Fragmentation of Immunoglobulin G," *Current Protocols in Cell Biology*, 2.8.1-2.8.10 (1997).
Antoniades et al., "Purification of human platelet-derived growth factor," *Proc. Natl. Acad. Sci. USA*, 76(4): 1809-1813 (1979).
Aoki et al., "Endothelial Progenitor Cell Capture by Stents Coated with Antibody Against CD34," *J. Am. Coll. Cardiol.*, 45(10): 1574-1579 (2005).
Arancio et al., "RAGE potentiates Aβ-induced perturbation of neuronal function in transgenic mice," *EMBO J.*, 23: 4096-4105 (2004).
Arimura et al., "Prevention of Allergic Inflammation by a Novel Prostaglandin Receptor Antagonist, S-5751," *J. Pharmacol. Exper. Therapeut.*, 298(2): 411-419 (2001).
Arndt et al., "Bispecific Diabodies for Cancer Therapy," *Methods Mol. Biol.*, 207: 305-321 (2003).
Aroonrerk et al., "A sensitive direct ELISA for detection of prostaglandin E2," *J. Immunoassay & Immunochem.*, 28:319-330 (2007).
Atwal et al., "A Therapeutic Antibody Targeting BACE1 Inhibits Amyloid-⊕ Production in Vivo," *Sci. Transl. Med.*, 3(84): 84ra43 (2011) [online]. Retrieved from: http://stm.sciencemag.org/content/3/84/84ra43 (12 pages).
Atwell et al., "Stable heterodimers from remodeling the domain interface of a homodimer using a phage display library," *J. Mol. Biol.*, 270: 26-35 (1997).
Ayoub et al., "Preferential Formation of MT1/MT2 Melatonin Receptor Heterodimers with Distinct Ligand Interaction Properties Compared with MT2 Homodimers," *Mol. Pharmacol.*, 66(2): 312-321 (2004).
Azzazy et al., "Phage display technology: clinical applications and recent innovations," *Clin. Biochem.*, 35: 425-445 (2002).
Babcook et al., "A novel strategy for generating monoclonal antibodies from single, isolated lymphocytes producing antibodies of defined specificities," *Proc. Natl. Acad. Sci. USA*, 93: 7843-7848 (1996).
Bäckström et al., "Signaling Efficiency of the T Cell Receptor Controlled by a Single Amino Acid in the b Chain Constant Region," *J. Exp. Med.*, 186 (11): 1933-1938 (1997).
Balthasar et al., "High-affinity rabbit antibodies directed against methotrexate: Production, purification, characterization, and pharmacokinetics in the rat," *J. Pharm. Sci.*, 84(1): 2-6 (1995) (Abstract only) (1 page).
Balthasar et al., "Inverse Targeting of Peritoneial Tumors: Selective Alteration of the Disposition of Methotrexate through the Use of Anti-Methotrexate Antibodies and Antibody Fragments," *J. Pharm. Sci.*, 85(10): 1035-1043 (1996).
Barbas et al., "Assembly of combinatorial antibody libraries on phage surfaces: The gene III site," *Proc. Natl. Acad. Sci. USA*, 88: 7978-7982 (1991).
Barbas et al., "In vitro evolution of a neutralizing human antibody to human immunodeficiency virus type 1 to enhance affinity and broaden strain cross-reactivity," *Proc. Natl. Acad. Sci. USA*, 91: 3809-3813 (1994).
Barrios et al., "Length of the antibody heavy chain complementarity determining region 3 as a specificity-determining factor," *J. Mol. Recog.*, 17: 332-338 (2004).
Baslund et al., "Targeting interleukin-15 in patients with rheumatoid arthritis," *Arthritis Rheum.*, 52(9): 2686-2692 (2005).
Baumgartner et al., "Double blind, placebo controlled trial of tumor necrosis factor receptor fusion protein (TNFR:Fc) in active rheumatoid arthritis," Biomedicine '96. Medical Research from Bench to Bedside. Washington, DC, May 3-6, 1996. *J. Invest. Med.*, 44(3):235A (Mar. 1996) (Abstract) (1 page).
Bergman et al. "Pharmacokinetics of IgG and IgM anti-ganglioside antibodies in rats and monkeys after intrathecal administration" *J. Pharmacol. Exp. Ther.*, 284(1): 111-115 (1998).

(56) References Cited

OTHER PUBLICATIONS

Berzofsky et al., "Immunogenicity and Antigen Structure," in *Fundamental Immunology*. (Paul, W.E. ed.), New York, NY: Raven Press, 1993; Chapter 8, p. 242 (1 page).
Bessis et al., "Use of hollow fibers filled with cells engineered to secrete IL-4 or IL-13 for treatment of experimental arthritis," (Abstract No. 1681), *Arthritis Rheum.*, 39(9Suppl.): S308 (1996) (1 page).
Better et al., "*Escherichia coli* Secretion of an Active Chimeric Antibody Fragment," *Science*, 240: 1041-1043 (1988).
Biewenga et al., "IgA1 half molecules in human multiple myeloma and the in vitro production of similar fragments from intact IgA1 molecules," *Clin. Exp. Immunol.*, 51: 395-400 (1983).
Bird et al., "Single-Chain Antigen-Binding Proteins," *Science*, 242: 423-426 (1988).
Boado et al., "Fusion Antibody for Alzheimer's Disease with Bidirectional Transport Across the Blood-Brain Barrier and Aβ Fibril Disaggregation," *Bioconj. Chem.*, 18(2): 447-455 (2007).
Bornemann et al., "Aβ-Induced Inflammatory Processes in Microglia Cells of APP23 Transgenic Mice," *Am. J. Pathol.*, 158(1): 63-73 (2001).
Boyce et al., "No audible wheezing: Nuggets and conundrums from mouse asthma models," *J. Exp. Med.*, 201(12): 1869-1873 (2005).
Braen et al., "A 4-week intrathecal toxicity and pharmacokinetic study with trastuzumab in cynomolgus monkeys," *Int. J. Toxicol.*, 29(3): 259-267 (2010).
Brand, D.D., "Rodent Models of Rheumatoid Arthritis," *Comparative Medicine*, 55(2): 114-122 (2005).
Bree et al., "IL-13 blockade reduces lung inflammation after *Ascaris scum* challenge in cynomolgus monkeys," *J. Allergy Clin. Immunol.*, 119(5): 1251-1257 (2007).
Brennan et al., "Preparation of Bispecific Antibodies by Chemical Recombination of Monoclonal Immunoglobulin $G_1$ Fragments," *Science*, 229: 81-83 (1985).
Brinkmann et al., "Phage display of disulfide-stabilized Fv fragments," *J. Immunol. Methods*, 182: 41-50 (1995).
Bruncko et al., "Studies leading to potent, dual inhibitors of Bcl-2 and Bcl-xL," *J. Med. Chem.*, 50(4): 641-662 (2007).
Brundo et al., "Glocal alignment: finding rearrangements during alignment," *Bioinformatics*, 19(Suppl. 1): i54-i62 (2003).
Brüsselbach et al., "Enzyme recruitment and tumor cell killing in vitro by a secreted bispecific single-chain diabody," *Tumor Targeting*, 4: 115-123 (1999).
Buchwald et al., "Long-term, continuous intravenous heparin administration by an implantable infusion pump in ambulatory patients with recurrent venous thrombosis," *Surgery*, 88: 507-516 (1980).
Buras et al., "Animal Models of Sepsis: Setting the Stage," *Nat. Rev. Drug. Discovery*, 4: 854-865 (2005).
Burke et al., "Zotarolimus (ABT-578) eluting stents," *Adv. Drug Del. Rev.*, 58: 437-446 (2006).
Burton et al., "Human Antibodies from Combinatorial Libraries," *Adv. Immunol.*, 57: 191-280 (1994).
Calandra et al., "Protection from septic shock by neutralization of macrophage migration inhibitory factor," *Nature Med.*, 6(2): 164-170 (2000).
Caron et al., "Chondroprotective Effect of Intraarticular Injections of Interleukin-1 Receptor Antagonist in Experimental Osteoarthritis," *Arthritis Rheum.*, 39: 1535-1544 (1996).
Carroll et al., "The selection of high-producing cell lines using flow cytometry and cell sorting," *Expert Opin. Biol. Ther.*, 4: 1821-1829 (2004).
Carter et al., "Humanization of an anti-p185$^{HER2}$ antibody for human cancer therapy," *Proc. Natl. Acad. Sci. USA*, 89: 4285-4289 (1992).
Carter, C.J., "Convergence of genes implicated in Alzheimer's disease on the cerebral cholesterol shuttle: APP, cholesterol, lipoproteins, and atherosclerosis," *Neurochem. Intl.*, 50:12-38 (2007).

Casset et al., "A peptide mimetic of an anti-CD4 monoclonal antibody by rational design," *Biochem. Biophys. Res. Commun.*, 307: 198-205 (2003).
Chakravarty et al., "Thermal ablation of tumor cells with antibody-functionalized single-walled carbon nanotubes," *PNAS*, 105(25): 8697-8702 (2008).
Chayen et al., "Protein crystallization: from purified protein to diffraction-quality crystal," *Nature Methods*, 5(2): 147-153 (2008).
Chayen, N.E., "Turning protein crystallisation from an art into a science" *Curr. Opin. Struct. Biol.*, 14: 577-583 (2004).
Chen et al., "Selection and analysis of an optimized anti-VEGF antibody: Crystal structure of an affinity matured Fab in complex with antigen," *J. Mol. Biol.*, 293: 865-881 (1999).
Chikanza et al., "Treatment of patients with rheumatoid arthritis with RP73401 phosphodiesterase Type IV inhibitor," (Abstract No. 1527), *Arthritis Rheum.*, 39(9 Suppl.): S282 (1996) (1 page).
Choi et al., "Recombinant chimeric OKT3 scFv IgM antibodies mediate immune suppression while reducing T cell activation in vitro," *Eur. J. Immunol.*, 31(1): 94-106 (2001).
Chothia et al., "Canonical Structures for the Hypervariable Regions of Immunoglobulins," *J. Mol. Biol.*, 196: 901-917 (1987).
Chothia et al., "Conformations of immunoglobulin hypervariable regions," *Nature*, 342: 877-883 (1989).
Clackson et al., "Making antibody fragments using phage display libraries," *Nature*, 352: 624-628 (1991).
Cleek et al., "Biodegradable Polymeric Carriers for a bFGF Antibody for Cardiovascular Application," *Proceed. Intl. Symp. Control. Rel. Bioact. Mater.*, 24: 853-854 (1997).
Co et al., "Genetically Engineered Deglycosylation of the Variable Domain Increases the Affinity of an Anti-CD33 Monoclonal Antibody," *Mol. Immunol.*, 30(15): 1361-1367 (1993).
Coffman et al., "Nonhuman primate models of asthma," *J. Exp. Med.*, 201(12): 1875-1879 (2005).
Colman, "Effects of amino acid sequence changes on antibody-antigen interactions," *Research in Immunology*, 145:33-36 (1994).
Coloma et al., "Design and production of novel tetravalent bispecific antibodies," *Nature Biotechnol.*, 15: 159-163 (1997).
Coloma et al., "Transport across the primate blood-brain barrier of a genetically engineered chimeric monoclonal antibody to the human insulin receptor," *Pharm. Res.*, 17(3): 266-274 (2000).
Cooper et al., "Variable domain-identical antibodies exhibit IgG subclass-related differences in affinity and kinetic constants as determined by surface plasmon resonance," *Mol. Immunol.*, 31(8): 577-584 (Jun. 1994).
Cot et al., "Production and characterization of highly specific anti-methotrexate monoclonal antibodies," *Hybridoma*, 6(1): 87-95 (1987).
Cox et al., "Measurement of cytokine release at the single cell level using the ELISPOT assay," *Methods*, 38(4): 274-282 (2006).
D'Andrea et al., "Production of Natural Killer Cell Stimulatory Factor (Interleukin 12) by Peripheral Blood Mononuclear Cells," *J. Exp. Med.*, 176: 1387-1398 (1992).
Dahesia et al., "The Interleukin 1β Pathway in the Pathogenesis of Osteoarthritis," *J. Rheumatol.*, 35(12): 2306-2312 (2008).
Dall'Acqua et al., "Contribution of Domain Interface Residues to the Stability of Antibody $C_H3$ Domain Homodimers," *Biochemistry*, 37: 9266-9273 (1998).
Dall'Acqua et al., "Increasing the affinity of a human IgG1 for the neonatal Fc receptor: Biological consequences," *J. Immunol.*, 169(9): 5171-5180 (2002).
Dall'Acqua et al., "Properties of human IgG1s engineered for enhanced binding to the neonatal Fc receptor (FcRn)," *J. Biol. Chem.*, 281: 23514-23524 (2006).
David et al., "Characterization of monoclonal antibodies against prostaglandin $E_2$: Fine specificity and neutralization of biological effects," *Mol. Immunol.*, 22(3): 339-346 (1985).
Dayer et al., "Collagenase Production by Rheumatoid Synovial Cells: Stimulation by a Human Lymphocyte Factor," *Science*, 195: 181-183 (1977).
Dayer et al., "Effects of Prostaglandin E2, Indomethacin, Trifluoperazine and Drugs Affecting the Cytoskeleton on Collagenase Production by Cultured Adherent Rheumatoid Synovial Cells," *Biochem. Pharmacol.*, 33(18): 2893-2899 (1984).

(56) References Cited

OTHER PUBLICATIONS

De Pascalis et al., "Grafting of 'Abbreviated' Complementarity-Determining Regions Containing Specificity-Determining Residues Essential for Ligand Contact to Engineer a Less Immunogenic Humanized Monoclonal Antibody," *J. Immunol.*, 169: 3076-3084 (2002).

Deane et al., "RAGE mediates amyloid-β peptide transport across the blood-brain barrier and accumulation in brain," *Nature Med.*, 9(7): 907-913 (2003).

Deluca et al., "Marine and botanical lipids as immunomodulatory and therapeutic agents in the treatment of rheumatoid arthritis," *Rheum. Dis. Clin. North Am.*, 21: 759-777 (1995).

Descotes, J., "Immunotoxicology of Immunomodulators," *Develop. Biol. Standard*, 77: 99-102 (1992).

Desmet et al., "Anchor profiles of HLA-specific peptides: analysis by a novel affinity scoring method and experimental validation," *Proteins*, 58: 53-69 (2005).

Desplat-Jego et al., "Anti-TWEAK monoclonal antibodies reduce immune cell infiltration in the central nervous system and severity of experimental autoimmune encephalomyelitis," *Clin. Immunol.*, 117(1): 15-23 (2005).

Dickson, B.J., "Molecular Mechanisms of Axon Guidance," *Science*, 298: 1959-1964 (2002).

Digiammarino et al., "Ligand association rates to the inner-variable-domain of a dual-variable-domain immunoglobulin are significantly impacted by linker design," *mAbs*, 3(5): 487-494 (2011).

Dinarello et al., "Immunological and Inflammatory Functions of the Interleukin-1 Family," *Annu. Rev. Immunol.*, 27: 519-550 (2009).

Dinarello et al., "Measurement of soluble and membrane-bound interleukin 1 using a fibroblast bioassay," Unit 6.2, in *Current Protocols in Immunology*, pp. 6.21-6.27 (2000) (7 pages).

Dohi et al., "Effect of combination Treatment with TNF-Inhibitor and Anti-TWEAK Antibody in Mouse Colitis Model," *Gastroenterology*, 138(5): S-413, Abstract M1758 (2010).

Domeniconi et al., "Overcoming inhibitors in myelin to promote axonal regeneration," *J. Neurological Sciences*, 233: 43-47 (2005).

During et al., "Controlled Release of Dopamine from a Polymeric Brain Implant: In Vivo Characterization," *Ann. Neurol.*, 25(4): 351-356 (1989).

Durocher et al., "High-level and high-throughput recombinant protein production by transient transfection of suspension-growing human 293-EBNA1 cells," *Nucl. Acids Res.*, 30(2): e9, (9 pages) (2002).

Economides et al., "Cytokine traps: multi-component, high-affinity blockers of cytokine action," *Nature Med.*, 9(1): 47-52 (2003).

Ehrich et al., "Demonstration of selective COX-2 inhibition by MK-966 in humans," (Abstract No. 328), *Arthritis Rheum.*, 39(9 Suppl.): S81 (1996) (1 page).

Ehrich et al., "Efficacy of MK-966, a highly selective inhibitor of COX-2, in the treatment of postoperative dental pain," (Abstract No. 329), *Arthritis Rheum.*, 39(9Suppl.): S81 (1996) (1 page).

European Patent Application No. 06813554.0: Supplementary European Search Report and Search Opinion, dated Sep. 21, 2009 (11 pages).

European Patent Application No. 06813554.0: Written Submission in Preparation to Oral Proceedings, dated Jan. 23, 2015 (100 pages).

European Patent Application No. 06813554.0: Minutes of Oral Proceedings, dated Jan. 29, 2015 (7 pages).

European Patent Application No. 06813554.0: Reply to Minutes of Oral Proceedings, dated Jan. 29, 2015 (1 page).

European Patent Application No. 07811045.9: Supplementary European Search Report and Search Opinion, dated Sep. 21, 2009 (7 pages).

European Patent Application No. 09739578.4: Supplementary European Search Report and Search Opinion, dated Mar. 28, 2012 (21 pages).

European Patent Application No. 09759344.6: Supplementary European Search Report and Search Opinion, dated Jun. 13, 2012 (12 pages).

European Patent Application No. 09759348.7: Supplementary European Search Report and Search Opinion, dated Jul. 4, 2012 (11 pages).

European Patent Application No. 09795128.9: Supplementary European Search Report and Search Opinion, dated May 22, 2013 (10 pages).

European Patent Application No. 09831213.5: Supplementary European Search Report and Search Opinion, dated Oct. 21, 2013 (6 pages).

European Patent Application No. 10770441.3 Supplementary European Search Report and Search Opinion, dated Sep. 23, 2013 (16 pages).

European Patent Application No. 10770449.6: Supplementary European Search Report and Search Opinion, dated Jul. 2, 2013 (8 pages).

European Patent Application No. 10805046.9: Supplementary European Search Report and Search Opinion, dated Mar. 26, 2013 (7 pages).

European Patent Application No. 10814433.8: Supplementary European Search Report and Search Opinion, dated Apr. 18, 2013 (11 pages).

European Patent Application No. 10824164.7: Supplementary European Search Report and Search Opinion, dated May 22, 2013 (11 pages).

European Patent Application No. 10825739.5: Supplementary European Search Report and Search Opinion, dated Apr. 29, 2013 (13 pages).

European Patent Application No. 10830460.1: Supplementary European Search Report and Search Opinion, dated Apr. 29, 2013 (15 pages).

European Patent Application No. 11798923.6: Supplementary European Search Report and Search Opinion, dated Jan. 2, 2014 (10 pages).

European Patent Application No. 11804385.0: Supplementary European Search Report and Search Opinion, dated Nov. 20, 2013 (16 pages).

European Patent Application No. 11815172.9: Partial Supplementary European Search Report, dated Nov. 12, 2014 (10 pages).

European Patent Application No. 11815172.9: Supplementary European Search Report and Search Opinion, dated Jan. 21, 2015 (16 pages).

European Patent Application No. 11820654.9: Supplementary European Search Report and Search Opinion, dated Dec. 17, 2013 (17 pages).

European Patent Application No. 11838670.5: Partial Supplementary European Search Report, dated Jun. 24, 2015 (10 pages).

European Patent Application No. 11838670.5: Supplementary European Search Report and Opinion, dated Oct. 13, 2015 (19 pages).

European Patent Application No. 14176206.2 by AbbVie Inc.: Extended European Search Report and Opinion, dated Nov. 12, 2014 (7 pages).

European Patent Application No. 15153941.8 by AbbVie Inc.: Extended European Search Report and Opinion, dated Jun. 10, 2015 (8 pages).

European Patent Application No. 15162013.5 by AbbVie Inc.: Partial European Search Report, dated Jul. 17, 2015 (8 pages).

European Patent Application No. 15162013.5 by AbbVie Inc.: Extended European Search Report, including Search Opinion, dated Nov. 10, 2015 (12 pages).

European Patent Application No. 15162064.8 by AbbVie Inc.: Partial European Search Report, dated Jul. 10, 2015 (8 pages).

European Patent Application No. 15162064.8 by AbbVie Inc.: European Search Report, dated Oct. 9, 2015 (15 pages).

European Patent Application No. 15189272.6 by AbbVie Inc.: Extended European Search Report, including Search Opinion, dated Feb. 16, 2016 (8 pages).

Evans et al., "Efficacy of tumor necrosis factor binding protein (TNF-bp) in the streptococcal cell wall-induced reactivation model of arthritis," (Abstract No. 1540), *Arthritis Rheum.*, 39(9 Suppl.): S284 (1996) (1 page).

(56) References Cited

OTHER PUBLICATIONS

Ewert et al., "Stability improvement of antibodies for extracellular and intracellular applications: CDR grafting to stable frameworks and structure-based framework engineering," *Methods*, 34: 184-199 (2004).
Farr et al., "Sulphasalazine (SASP) in rheumatoid arthritis (RA): A 5 year prospective study," (Abstract No. 1519), *Arthritis Rheum.*, 39(9 Suppl.): S281 (1996) (1 page).
Fernandes et al., "In Vivo Transfer of Interleukin-1 Receptor Antagonist Gene in Osteoarthritic Rabbit Knee Joints," *Am. J. Pathol.*, 154(4): 1159-1169 (1999).
Ferrara et al., "The Biology of Vascular Endothelial Growth Factor," *Endocr. Rev.*, 18(1): 4-25 (1997).
Ferrara et al., "The biology of VEGF and its receptors" *Nat. Med.*, 9(6): 669-676 (2003).
Fiebich et al., "Effects of NSAIDs on IL-1-beta-induced IL-6 mRNA and protein synthesis in human astrocytoma cells," *NeuroReport*, 7: 1209-1213 (1996).
Finnegan et al., "Leflunomide inhibits immunoglobulin production by two separate mechanisms," (Abstract No. 627), *Arthritis Rheum.*, 39(9 (Suppl.): S131 (1996) (1 page).
Finotto, et al., "Asthmatic changes in mice lacking T-bet are mediated by IL-13," *Int. Immunol.*, 17(8): 993-1007 (2005).
Flierl et al., "Adverse functions of IL-17A in experimental sepsis," *FASEB J.*, 22: 2198-2205 (2008).
Friden et al., "Anti-transferrin receptor antibody and antibody-drug conjugates cross the blood-brain barrier," *Proc. Natl. Acad. Sci. USA*, 88:4771-4775 (1991).
Fuchs et al., "Targeting Recombinant Antibodies to the Surface of *Escherichia coli*: Fusion to a Peptidoglycan Associated Lipoprotein," *Bio/Technology*, 9: 1369-1372 (1991).
Fuh et al., "Structure-Function Studies of Two Synthetic Anti-vascular Endothelial Growth Factor Fabs and Comparison with the Avastin™ Fab," *J. Biol. Chem.*, 281(10): 6625-6631 (2006).
Garber, K., "Targeting vessel abnormalization in cancer," *J. Natl. Canc. Inst.*, 99(13): 991-995 (2007).
Garber, K, "Anti-IL-17 mAbs herald new options in psoriasis," *Nat. Biotechnol.*, 30(6): 475-477 (2012).
Garg et al., "Investigation of the influence of FcRn on the distribution of IgG to the brain," *AAPS J.*, 11(3): 553-557 (2009).
Garrard et al., "$F_{AB}$ Assembly and Enrichment in a Monovalent Phage Display System," *Bio/Technology*, 9: 1373-1377 (1991).
Gavilondo et al., "Antibody Engineering at the Millennium," *Biotechniques*, 29: 128-145 (2000).
Genain et al., "Creation of a model for multiple sclerosis in *Callithrix jacchus* marmosets," *J. Mol. Med.*, 75(3): 187-197 (1997).
Genbank Accession No. BAL50004, "Anti-prostaglandin E2 antibody kappa light chain [Mus musculus]," Feb. 4, 2012 (2 pages).
Genbank Accession No. U17870, "Cricetulus migratorius 145.2c11 kappa light chain mRNA, complete cds," ROD Feb. 7, 1996 (2 pages).
Genbank Accession No. U17871, "Cricetulus migratorius 145.2c11 heavy chain mRNA, partial cds," Feb. 7, 1996 (2 pages).
Genbank Accession No. X99230, "M.musculus mRNA for immunoglobulin heavy chain variable domain, subgroup IIb," ROD Oct. 8, 1996 (2 pages).
Genbank Accession No. X99232, "M.musculus mRNA for immunoglobulin light chain variable domain, subgroup III," ROD Oct. 8, 1996 (2 pages).
Genbank Accession No. Y14283, "Mus musculus mRNA for immunoglobulin heavy chain variable region, subunits VH, DH and JH'" ROD May 26, 1998 (2 pages).
Genbank Accession No. Y14284, "Mus musculus mRNA for immunoglobulin light chain variable region, subunits VL and JL," ROD May 26, 1998 (2 pages).
Genovese et al., "Abatacept for Rheumatoid Arthritis Refractory to Tumor Necrosis Factor α Inhibition," *N. Engl. J. Med.*, 353: 1114-1123 (2005).
GENESEQ™ database, "Mouse anti-hIL13 humanized mAb LC variable region polypeptide SEQ: 71," Thomson Reuters, Philadelphia, USA; Accession No. AZK48805, Dec. 10, 2015 (2 pages).
GENESEQ™ database, "Humanized anti-TNF MAK-199 Ab VH region, SEQ: 91," Thomson Reuters, Philadelphia, USA; Accession No. BAN99936, Dec. 10, 2015 (2 pages).
GENESEQ™ database, "Anti-IL13 antibody heavy chain variable region (VH), SEQ ID: 32," Thomson Reuters, Philadelphia, USA; Accession No. BAQ31976, Dec. 10, 2015 (2 pages).
GENESEQ™ database, "Anti-TNF antibody VL (AB444VL), SEQ ID 49," Thomson Reuters, Philadelphia, USA; Accession No. BBN15100, Dec. 10, 2015 (2 pages).
Germain et al., "Redirecting NK cells mediated tumor cell lysis by a new recombinant bifunctional protein," *Protein Engineering Design and Selection*, 21(11): 665-672 (2008).
Ghetie et al., "Increasing the serum persistence of an IgG fragment by random mutagenesis," *Nature Biotechnol.*, 15(7): 637-640 (1997).
Giegé et al., "An introduction to the crystallogenesis of biological macromolecules," in *Crystallization of Nucleic Acids and Proteins. A Practical Approach*. 2nd ed., (Ducruix and Giegé, eds.), Oxford University Press, New York, 1999; chapter 1, pp. 1-16.
Glennie et al., "Preparation and Performance of Bispecific F(ab'γ)$_2$ Antibody Containing Thioether-Linked Fab'γ Fragments," *J. Immunol.*, 139(7): 2367-2375 (1987).
Gold and Lühder, "Interleukin-17—Extended Features of a Key Player in Multiple Sclerosis," *Am. J. Pathol.*, 172(1): 8-10 (2008).
Goldring et al., "Interleukin 1 Suppresses Expression of Cartilage-specific Types II and IX Collagens and Increases Types I and III Collagens in Human Chondrocytes," *J. Clin. Investig.*, 82: 2026-2037 (1988).
Goldring et al., "Modulation by Recombinant Interleukin 1 of Synthesis of Types I and III Collagens and Associated Procollagen mRNA Levels in Cultured Human Cells," *J. Biol. Chem.*, 262: 16724-16729 (1987).
Goldspiel et al., "Human Gene Therapy," *Clin. Pharm.*, 12: 488-505 (1993).
Golde et al., "Quantitative and mechanistic studies of Aβ immunotherapy," *CNS Neurol. Disord. Drug Targets*, 8: 31-49 (2009).
Goodson, J.M., "Dental Applications," Chapter 6, in *Medical Applications of Controlled Release*, vol. II, *Applications and Evaluation*. (Langer and Wise, eds.) (CRC Press, Inc., Boca Raton, 1984), pp. 115-138.
Gracie et al., "A proinflammatory role for IL-18 in rheumatoid arthritis," *J. Clin. Invest.*, 104(10): 1393-1401 (1999).
Gram et al., "In vitro selection and affinity maturation of antibodies from a naive combinatorial immunoglobulin library," *Proc. Natl. Acad. Sci. USA*, 89: 3576-3580 (1992).
Green et al., "Antigen-specific human monoclonal antibodies from mice engineered with human Ig heavy and light chain YACs," *Nature Genetics*, 7: 13-21 (1994).
Green et al., "Regulation of B Cell Development by Variable Gene Complexity in Mice Reconstituted with Human Immunoglobulin Yeast Artificial Chromosomes," *J. Exp. Med.*, 188(3): 483-495 (1998).
Griffin et al., "Blockade of T Cell Activation Using a Surface-Linked Single Chain Antibody to CTLA-4 (CD152)," *J. Immunol.*, 164: 4433-4442 (2000).
Griffiths et al., "Human anti-self antibodies with high specificity from phage display libraries," *EMBO J.*, 12(2): 725-734 (1993).
Grothey and Galanis, "Targeting angiogenesis: progress with anti-VEGF treatment with large molecules," *Nat. Rev. Clin. Oncol.*, 6: 507-518 (2009).
Gu et al., "Generation of Dual-Variable-Domain Immunoglobulin Molecules for Dual-Specific Targeting," *Methods in Enzymology*, 502: 25-41 (2012).
Gurney and Hoey, "Anti-DLL4, a cancer therapeutic with multiple mechanisms of action" *Vascular Cell*, 3:18, 4 pages (2011).
Güssow et al., "Humanization of Monoclonal Antibodies," *Methods Enzymol.*, 203: 99-121 (1991).

(56) References Cited

OTHER PUBLICATIONS

Guttadauria, M., "Tenidap in Rheumatoid Arthritis Collaborative International Study (TRACIS): a 6-month interim analysis," (Abstract No. 1516), *Arthritis Rheum.*, 39(9 Suppl.): S280 (1996) (1 page).
Hämmerling et al. (eds.), "Appendix: Production of Antibody-Producing Hybridomas in the Rodent Systems," in *Monoclonal Antibodies and T-Cell Hybridomas. Perspectives and Technical Advances. Research Monographs in Immunology*, vol. 3. Elsevier, New York, 1981; pp. 563-587.
Hanasaki et al., "Binding of Human Plasma Sialoglycoproteins by the B Cell-specific Lectin CD22," *J. Biol. Chem.*, 270(13): 7543-7550 (1995).
Hara et al., "Therapeutic effect of T-614, a new anti-arthritic agent, on rheumatoid arthritis," (Abstract No. 1526), *Arthritis Rheum.*, 39(9 Suppl.): S282 (1996) (1 page).
Harriman et al., "Summary of clinical trials in rheumatoid arthritis using infliximab, an anti-TNFα treatment," *Ann. Rheum. Dis.*, 58(Suppl. I): I61-I64 (1999) (4 pages).
Hart et al., "Preclinical efficacy and safety of mepolizumab (SB-240563), a humanized monoclonal antibody to IL-5, in cynomolgus monkeys," *J. Allergy Clin. Immunol.*, 108(2): 250-257 (2001).
Hart et al., "Suppression of Ongoing Disease in a Nonhuman Primate Model of Multiple Sclerosis by a Human-Anti-Human IL-12p40 Antibody," *J. Immunol.*, 175(7): 4761-4768 (2005).
Hawkins et al., "Selection of Phage Antibodies by Binding Affinity. Mimicking Affinity Maturation," *J. Mol. Biol.*, 226: 889-896 (1992).
Hay et al., "Bacteriophage cloning and *Escherichia coli* expression of a human IgM Fab," *Hum. Antibod. Hybridomas*, 3: 81-85 (1992).
Henry et al., "A Prostate-Specific Membrane Antigen Targeted Monoclonal Antibody-Chemotherapeutic Conjugate Designed for the Treatment of Prostate Cancer," *Cancer Res.*, 64: 7995-8001 (2004).
Herz, J., "Apolipoprotein E receptors in the nervous system," *Curr. Opin. Lipidol.*, 20: 190-196 (2009).
Hezareh et al., "Effector Function Activities of a Panel of Mutants of a Broadly Neutralizing Antibody against Human Immunodeficiency Virus Type 1," *J. Virol.*, 75(24): 12161-12168 (Dec. 2001).
Hibi et al., "Splicing variations in the ligand-binding domain of ApoER2 results in functional differences in the binding properties to Reelin," *Neurosci. Res.*, 63:251-258 (2009).
Hickey et al., "The Rheumatoid Arthritis Azathioprine Registry (RAAR)—interim analysis of malignancy and mortality," (Abstract No. 1521), *Arthritis Rheum.*, 39(9 Suppl.): S281 (1996) (1 page).
Hildebrand et al., "Surface coatings for biological activation and functionalization of medical devices," *Surface & Coatings Technology*, 200: 6318-6324 (2006).
Hill et al., "Interleukin-17 deficiency improves locomotor recovery and tissue sparing after spinal cord contusion injury in mice," *Neurosci. Lett.*, 487(3): 363-367 (2011).
Hindawi et al., "The development and application of a direct radioimmunoassay for prostaglandin E2 utilising a α-labelled ligand," *Prostaglandins, Leukotrienes and Medicine*, 18: 81-94 (1985).
Hinton et al., "Engineered human IgG antibodies with longer serum half-lives in primates," *J. Biol. Chem.* 279(8): 6213-6216 (2004).
Hirota et al., "Reelin Receptors ApoER2 and VLDLR Are Expressed in Distinct Spatiotemporal Patterns in Developing Mouse Cerebral Cortex" *J. Comp. Neurol.*, 523: 463-478 (2015).
Holliger et al., "'Diabodies': Small bivalent and bispecific antibody fragments," *Proc. Natl. Acad. Sci. USA*, 90: 6444-6448 (1993).
Holliger et al., "Diabodies: Small bispecific antibody fragments," *Cancer Immunol. Immunother.*, 45: 128-130 (1997).
Holm et al., "Functional mapping and single chain construction of the anti-cytokeratin 8 monoclonal antibody TS1," *Mol. Immunol.*, 44: 1075-1084 (2007).
Honegger et al., "Yet Another Numbering Scheme for Immunoglobulin Variable Domains: An Automatic Modeling and Analysis Tool," *J. Mol. Biol.*, 309(3): 657-670 (2001).
Honkanen et al., "IL-17 Immunity in Human Type 1 Diabetes," *J. Immunol.*, 185: 1959-1967 (2010).
Honorati et al., "Contribution of interleukin 17 to human cartilage degradation and synovial inflammation in osteoarthritis," *Osteoarthritis and Cartilage*, 10: 799-807 (2002).
Hoogenboom et al., "Multi-subunit proteins on the surface of filamentous phage: Methodologies for displaying antibody (Fab) heavy and light chains," *Nucl. Acids Res.*, 19(15): 4133-4137 (1991).
Hoogenboom et al., "Natural and designer binding sites made by phage display technology," *Immunol. Today*, 21(8): 371-378 (2000).
Hoogenboom, H.R., "Designing and optimizing library selection strategies for generating high-affinity antibodies," *Trends Biotechnol.*, 15: 62-70 (1997).
Hoogenboom, H.R., "Mix and match: Building manifold binding sites," *Nature Biotechnol.*, 15: 125-126 (1997).
Howard et al., "Intracerebral drug delivery in rats with lesion-induced memory deficits," *J. Neurosurg.*, 71: 105-112 (1989).
Hsieh et al., "Discovery and Characterization of ABT-122, an Anti-TNF/IL-17 DVD-Ig™ Molecule as a Potential Therapeutic Candidate for Rheumatoid Arthritis," *Ann. Rheum. Dis.*, 73(Suppl. 2):495, Abstract FRI0303 (2014).
Huber et al., "Crystallographic structure studies of an IgG molecule and an Fc fragment," *Nature*, 264: 415-420 (1976).
Huse et al., "Generation of a Large Combinatorial Library of the Immunoglobulin Repertoire in Phage Lambda," *Science*, 246: 1275-1281 (1989).
Huston et al., "Protein engineering of antibody binding sites: Recovery of specific activity in an anti-digoxin single-chain Fv analogue produced in *Escherichia coli*," *Proc. Natl. Acad. Sci. USA*, 85: 5879-5883 (1988).
Huston et al., "Protein Engineering of Single-Chain Fv Analogs and Fusion Proteins," *Methods Enzymol.*, 203: 46-88 (1991).
Hwang et al., "Cutting Edge: Targeted Ligation of CTLA-4 In Vivo by Membrane-Bound Anti-CTLA-4 Antibody Prevents Rejection of Allogeneic Cells," *J. Immunol.*, 163: 633-637 (2002).
Hwang et al., "Use of human germline genes in a CDR homology-based approach to antibody humanization," *Methods*, 36: 35-42 (2005).
Inter Partes Reexamination (Control No. 95/001,380) of U.S. Pat. No. 7,612,181 (U.S. Appl. No. 11/507,050): Replacement Request, dated Jun. 24, 2010 (62 pages).
Inter Partes Reexamination (Control No. 95/001,380) of U.S. Pat. No. 7,612,181 (U.S. Appl. No. 11/507,050): Order Granting Request for Inter Partes Reexamination, issued Sep. 1, 2010 (18 pages).
Inter Partes Reexamination (Control No. 95/001,380) of U.S. Pat. No. 7,612,181 (U.S. Appl. No. 11/507,050): Reexamination Non-Final Office Action, dated Sep. 1, 2010 (13 pages).
Inter Partes Reexamination (Control No. 95/001,380) of U.S. Pat. No. 7,612,181(U.S. Appl. No. 11/507,050): Response After Non-Final Action—Owner Timely ("Patent Owner's Response Pursuant to 37 CFR § 1.945"), dated Nov. 1, 2010 (71 pages).
Inter Partes Reexamination (Control No. 95/001,380) of U.S. Pat. No. 7,612,181 (U.S. Appl. No. 11/507,050): Third Party Requester Comments After Non-Final Action ("Sanofi's Comments Pursuant to 37 CFR § 1.947"), dated Dec. 1, 2010 (81 pages).
Inter Partes Reexamination (Control No. 95/001,380) of U.S. Pat. No. 7,612,181 (U.S. Appl. No. 11/507,050): Reexamination Non-Final Office Action ("Action Closing Prosecution"), dated Sep. 1, 2011.
Inter Partes Reexamination (Control No. 95/001,380) of U.S. Pat. No. 7,612,181 (U.S. Appl. No. 11/507,050): Patent Owner Comments After Action Closing Prosecution ("Response Pursuant to 37 CFR § 1.951(a)"), dated Oct. 31, 2011.
Inter Partes Reexamination (Control No. 95/001,380) of U.S. Pat. No. 7,612,181 (U.S. Appl. No. 11/507,050): Third Party Requester Comments after Action Closing Prosecution ("Sanofi's Comments Pursuant to 37 CFR §1.951(a)"), dated Nov. 30, 2011.
Inter Partes Reexamination (Control No. 95/001,380) of U.S. Pat. No. 7,612,181 (U.S. Appl. No. 11/507,050): Right of Appeal Notice (37 CFR 1.953), dated Mar. 7, 2012.

(56) References Cited

OTHER PUBLICATIONS

Inter Partes Reexamination (Control No. 95/001,380) of U.S. Pat. No. 7,612,181 (U.S. Appl. No. 11/507,050): Decision on Appeal, dated Mar. 24, 2014.
Inter Partes Reexamination (Control No. 95/001,380) of U.S. Pat. No. 7,612,181 (U.S. Appl. No. 11/507,050): Request to Reopen Prosecution Pursuant to 37 CFR § 41.77(b)(1), dated May 23, 2014.
Inter Partes Reexamination (Control No. 95/001,380) of U.S. Pat. No. 7,612,181 (U.S. Appl. No. 11/507,050): Third Party Requester Comments on Patent Owner Response after Board Decision ("Sanofi's Comments Pursuant to 37 C.F.R. § 41.77(c)"), dated Jun. 22, 2014.
Inter Partes Reexamination (Control No. 95/001,380) of U.S. Pat. No. 7,612,181 (U.S. Appl. No. 11/507,050): Record of Oral Hearing, dated Aug. 4, 2014.
Inter Partes Reexamination (Control No. 95/001,380) of U.S. Pat. No. 7,612,181 (U.S. Appl. No. 11/507,050): Order Reopening Prosecution and Remanding Inter Partes Reexamination Under 37 C.F.R. § 41.77(d), dated Nov. 20, 2014.
Inter Partes Reexamination (Control No. 95/001,380) of U.S. Pat. No. 7,612,181 (U.S. Appl. No. 11/507,050): Examiner's Determination on Patent Owner Response/Requester Comments After Board Decision, dated Jun. 2, 2015.
Inter Partes Reexamination (Control No. 95/001,380) of U.S. Pat. No. 7,612,181 (U.S. Appl. No. 11/507,050): Patent Owner's Comments on Examiner's Determination after Board Decision ("Patent Owner's Comments Under 37 C.F.R. § 41.77(e)"), dated Jul. 2, 2015.
Inter Partes Reexamination (Control No. 95/001,380) of U.S. Pat. No. 7,612,181 (U.S. Appl. No. 11/507,050): Requester Comments on Patent Owner Response after Board Decision ("Sanofi's Comments Pursuant to 37 C.F.R. § 41.77(e)"), dated Aug. 2, 2015.
Inter Partes Reexamination (Control No. 95/001,380) of U.S. Pat. No. 7,612,181 (U.S. Appl. No. 11/507,050): Patent Owner's Request for Oral Hearing and Petition Under 37 C.F.R. § 1.183 for Oral Hearing, dated Sep. 4, 2015.
Inter Partes Reexamination (Control No. 95/001,380) of U.S. Pat. No. 7,612,181 (U.S. Appl. No. 11/507,050): Decision on Patent Owner's Petition Under 37 C.F.R. § 1.183 for Oral Hearing, dated Mar. 7, 2016.
International Patent Application No. PCT/US2006/032398: International Search Report and Written Opinion, dated Aug. 18, 2008 (14 pages).
International Patent Application No. PCT/US2006/032398: International Preliminary Report on Patentability, dated Jul. 6, 2010 (14 pages).
International Patent Application No. PCT/US2007/017340: International Search Report and Written Opinion, dated Jun. 24, 2008 (5 pages).
International Patent Application No. PCT/US2007/017340: International Preliminary Report on Patentability, dated Nov. 14, 2008 (3 pages).
International Patent Application No. PCT/US2009/041945: International Search Report and Written Opinion, dated Nov. 2, 2009 (12 pages).
International Patent Application No. PCT/US2009/041945: International Preliminary Report on Patentability, dated Aug. 9, 2010 (12 pages).
International Patent Application No. PCT/US2009/046130: International Search Report and Written Opinion, dated Jan. 11, 2010 (17 pages).
International Patent Application No. PCT/US2009/046130: International Preliminary Report on Patentability, dated Aug. 21, 2010 (13 pages).
International Patent Application No. PCT/US2009/046137: International Search Report and Written Opinion, dated Jan. 12, 2010 (18 pages).
International Patent Application No. PCT/US2009/046137: International Preliminary Report on Patentability, dated Jun. 18, 2010 (14 pages).
International Patent Application No. PCT/US2009/049953: International Search Report and Written Opinion, dated Oct. 29, 2009 (10 pages).
International Patent Application No. PCT/US2009/049954: International Search Report and Written Opinion, dated Mar. 31, 2010 (14 pages).
International Patent Application No. PCT/US2009/049954: International Preliminary Report on Patentability, dated Jul. 2, 2011 (11 pages).
International Patent Application No. PCT/US2009/066815: International Search Report and Written Opinion, dated Mar. 23, 2010 (14 pages).
International Patent Application No. PCT/US2009/066815: International Preliminary Report on Patentability, dated Jan. 6, 2011 (13 pages).
International Patent Application No. PCT/US2010/033231: International Search Report and Written Opinion, dated Nov. 22, 2010 (10 pages).
International Patent Application No. PCT/US2010/033231: International Preliminary Report on Patentability, dated Apr. 27, 2011 (10 pages).
International Patent Application No. PCT/US2010/033246: International Search Report and Written Opinion, dated Nov. 24, 2010 (18 pages).
International Patent Application No. PCT/US2010/033246: International Preliminary Report on Patentability, dated May 4, 2011 (28 pages).
International Patent Application No. PCT/US2010/043716: International Search Report and Written Opinion, dated Feb. 28, 2011 (17 pages).
International Patent Application No. PCT/US2010/043716: International Preliminary Report on Patentability, dated Aug. 31, 2012 (24 pages).
International Patent Application No. PCT/US2010/047543: International Search Report and Written Opinion, dated Feb. 24, 2011 (14 pages).
International Patent Application No. PCT/US2010/052843: International Search Report and Written Opinion, dated Jul. 1, 2011 (21 pages).
International Patent Application No. PCT/US2010/053730: International Search Report and Written Opinion, dated May 6, 2011 (13 pages).
International Patent Application No. PCT/US2010/053730: International Preliminary Report on Patentability, dated Nov. 21, 2011 (12 pages).
International Patent Application No. PCT/US2010/054521: International Search Report and Written Opinion, dated May 26, 2011 (12 pages).
International Patent Application No. PCT/US2010/054521: International Preliminary Report on Patentability, dated Feb. 8, 2012 (12 pages).
International Patent Application No. PCT/US2011/041633: International Search Report and Written Opinion, dated Mar. 13, 2012 (16 pages).
International Patent Application No. PCT/US2011/043297: International Search Report and Written Opinion, dated Feb. 28, 2012 (19 pages).
International Patent Application No. PCT/US2011/046233: International Search Report and Written Opinion, dated Apr. 3, 2012 (17 pages).
International Patent Application No. PCT/US2011/049147: International Search Report and Written Opinion, dated Mar. 21, 2012 (16 pages).
International Patent Application No. PCT/US2011/058769: International Search Report and Written Opinion, dated Jun. 15, 2012 (15 pages).
International Patent Application No. PCT/US2011/059074: International Search Report and Written Opinion, dated Jun. 15, 2012 (18 pages).
International Patent Application No. PCT/US2012/071897: International Search Report and Written Opinion, dated Sep. 3, 2013 (17 pages).

(56) References Cited

OTHER PUBLICATIONS

International Patent Application No. PCT/US2012/071929: International Search Report and Written Opinion, dated Sep. 11, 2013 (29 pages).
International Patent Application No. PCT/US2012/072017: International Search Report and Written Opinion, dated Jul. 17, 2013 (24 pages).
International Patent Application No. PCT/US2013/067873: International Search Report and Written Opinion, dated May 8, 2014 (23 pages).
International Patent Application No. PCT/US2013/073114, filed Dec. 4, 2013 by AbbVie, Inc.: International Search Report and Written Opinion, dated Jul. 7, 2014 (24 pages).
International Patent Application No. PCT/US2014/028618: Invitation to Pay Additional Fees and Communication Relating to the Results of the Partial International Search, dated Aug. 13, 2014 (8 pages).
International Patent Application No. PCT/US2014/028618: International Search Report and Written Opinion, dated Oct. 28, 2014 (25 pages).
International Patent Application No. PCT/US2014/028646: International Search Report and Written Opinion, dated Oct. 17, 2014 (18 pages).
International Patent Application No. PCT/US2014/028646: Invitation to Pay Additional Fees and Communication Relating to the Results of the Partial International Search, dated Aug. 14, 2014 (10 pages).
International Patent Application No. PCT/US2015/035441: Invitation to Pay Additional Fees, with Communication Relating to the Results of the Partial International Search, dated Oct. 7, 2015 (6 pages).
International Patent Application No. PCT/US2015/035441: International Search Report and Written Opinion, dated Dec. 10, 2015 (18 pages).
International Patent Application No. PCT/US2015/065406: Invitation to Pay Additional Fees, with Communication Relating to the Results of the Partial International Search, dated Apr. 15, 2016 (9 pages).
Ito et al., "Transfer of Severe Experimental Autoimmune Encephalomyelitis by IL-12- and IL-18-Potentiated T Cells is Estrogen Sensitive," *J. Immunol.*, 170(9): 4802-4809 (2003).
Jackson et al., "In Vitro Antibody Maturation, Improvement of a High Affinity, Neutralizing Antibody Against IL-1β," *J. Immunol.*, 154(7): 3310-3319 (1995).
Jakob et al., "Structure reveals function of the dual variable domain immunoglobulin (DVD-Ig™) molecule," mAbs, 5(3): 358-363 (2013).
Jakubowski et al., "Dual role for TWEAK in angiogenic regulation," *J. Cell Sci.*, 115(2): 267-274 (2002).
Janelsins et al., "Early correlation of microglial activation with enhanced tumor necrosis factor—alpha and monocyte chemoattractant protein-I expression specifically within the entorhinal cortex of triple transgenic Alzheimer's disease mice," *J. Neuroinflammation*, 2(23): 1-12 (2005).
Janeway et al., *Immunobiology. The Immune System in Health and Disease*. 3rd Ed. Current Biology Ltd./Garland Publishing Inc., 1997; Chapter 3, pp. 1-11.
Jefferis, R., "Glycosylation of Recombinant Antibody Therapeutics," *Biotechnol. Prog.*, 21: 11-16 (2005).
Jendreyko et al., "Intradiabodies, Bispecific, Tetravalent Antibodies for the Simultaneous Functional Knockout of Two Cell Surface Receptors," *J. Biol. Chem.*, 278(48): 47812-47819 (2003).
Jiang et al., "Regulation of recombinant monoclonal antibody production in Chinese hamster ovary cells: A comparative study of gene copy number, mRNA level, and protein expression," *Biotechnol. Prog.*, 22(1): 313-318 (2006).
Jin et al., "Pharmacokinetic and Pharmacodynamic Effects of High-Dose Monoclonal Antibody Therapy in a Rat Model of Immune Thrombocytopenia," *The AAPS Journal*, 7(4):Article 87, E895-E902 (2006) [online]. Retrieved from: http://www.springerlink.com/content/v6n04672761n9313/fulltext.pdf.
Joachimiak, "High-throughput crystallography for structural genomics" *Curr. Opin. Struct. Biol.*, 19: 573-584 (2009).
Johnsson et al., "Comparison of Methods for Immobilization to Carboxymethyl Dextran Sensor Surfaces by Analysis of the Specific Activity of Monoclonal Antibodies," *J. Mol. Recognit.*, 8: 125-131 (1995).
Johnsson et al., "Immobilization of Proteins to a Carboxymethyldextran-Modified Gold Surface for Biospecific Interaction Analysis in Surface Plasmon Resonance Sensors," *Anal. Biochem.*, 198: 268-277 (1991).
Joliot et al., "Antennapedia homeobox peptide regulates neural morphogenesis," *Proc. Natl. Acad. Sci. USA*, 88: 1864-1868 (1991).
Jones et al., "Replacing the complementarity-determining regions in a human antibody with those from a mouse," *Nature*, 321: 522-525 (1986).
Jones, A.G., "Particle formation and separation in suspension crystallization processes," Chapter 4, In *Process. Solid-Liq. Suspensions*, (P. Ayazi Shamlou, ed.) (Butterworth-Heinemann, Oxford, UK, 1993) pp. 93-117.
Jones, A.J.S., "Analytical methods for the assessment of protein formulations and delivery systems," Chapter 2, In *Formulation and Delivery of Proteins and Peptides*, 1st ed., (Cleland and Langer, eds.) (American Chemical Society, Washington, D.C., 1994) pp. 22-45.
Jones, R., "Rovelizumab—ICOS Corp," *IDrugs*, 3(4): 442-446 (2000).
Jönsson et al., "Introducing a biosensor based technology for real-time biospecific interaction analysis," *Ann. Biol. Clin.*, 51: 19-26 (1993).
Jönsson, et al., "Real-Time Biospecific Interaction Analysis Using Surface Plasmon Resonance and a Sensor Chip Technology," *BioTechniques*, 11(5): 620-627 (1991).
Joosten et al., "Anticytokine Treatment of Established Type II Collagen-Induced Arthritis in DBA/1 Mice," *Arthritis Rheum.*, 39(5): 797-809 (1996).
Jotanovic et al., "Role of Interleukin-1 Inhibitors in Osteoarthritis," *Drugs Aging*, 29(5): 343-358 (2012).
Ju et al., "Inhibitory effects of nardostachin on nitric oxide, prostaglandin E2, and tumor necrosis factor-alpha production in lipopolysaccharide activated macrophages," *Biol. Pharm. Bull.* 26: 1375-1378 (2003).
Jungbluth et al., "A monoclonal antibody recognizing human cancers with amplification/overexpression of the human epidermal growth factor receptor," *Proc. Natl. Acad. Sci. USA*, 100(2): 639-644 (2003).
Kabat et al., "Attempts to Locate Complementarity-Determining Residues in the Variable Positions of Light and Heavy Chains," *Ann. NY Acad. Sci.*, 190: 382-391 (1971).
Kaine et al., "Results of a multi-dose protocol 7002 using an immunomodulating, non-depleting Primatized™ anti-CD4 monoclonal antibody in rheumatoid arthritis (RA)," (Abstract No. 195), *Arthritis Rheum.*, 38: S185 (1995) (1 page).
Kanda et al., "Establishment of a GDP-mannose 4,6-dehydratase (GMD) knockout host cell line: A new strategy for generating completely non-fucosylated recombinant therapeutics," *J. Biotechnol.*, 130(3): 300-310 (2007).
Kapadia et al., "Soluble TNF binding proteins modulate the negative inotropic properties of TNF-alpha in vitro," *Am. J. Physiol. Heart Circ. Physiol.* 268 (2 Pt. 2): H517-H525 (1995).
Karlin and Altschul, "Applications and statistics for multiple high-scoring segments in molecular sequences," *Proc. Natl. Acad. Sci. USA*, 90:5873-5877 (1993).
Karnezis et al., "The neurite outgrowth inhibitor Nogo A is involved in autoimmune-mediated demyelination," *Nature Neurosci.*, 7: 736-744 (2004).
Karni et al., "IL-18 is linked to raised IFN-γ in multiple sclerosis and is induced by activated CD4$^+$ T cells via CD40-CD40 ligand interactions," *J. Neuroimmunol.*, 125: 134-140 (2002).
Kashmiri et al., "SDR grafting—a new approach to antibody humanization," *Methods*, 36(1): 25-34 (2005).

(56) References Cited

OTHER PUBLICATIONS

Kaufman and Sharp, "Amplification and expression of sequences cotransfected with a modular dihydrofolate reductase complementary DNA gene," *J. Mol. Biol.*, 159(4): 601-621 (1982).
Keith Jr., et al., "Recombinant human interleukin eleven decreases arthritis in HLA-B27 transgenic rats," (Abstract No. 1613), *Arthritis Rheum.*, 39(9 Suppl.): S296 (1996) (1 page).
Kellerman et al., "Antibody discovery: The use of transgenic mice to generate human monoclonal antibodies for therapeutics," *Curr. Opin. Biotechnol.*, 13: 593-597 (2002).
Kellner, H., "Targeting interleukin-17 in patients with active rheumatoid arthritis: rationale and clinical potential," *Ther. Adv. Musculoskel. Dis.*, 5(3):141-152 (2013).
Kettleborough et al., "Humanization of a mouse monoclonal antibody by CDR-grafting: the importance of framework residues on loop conformation," *Protein Eng.*, 4(7): 773-783 (1991).
Kettleborough et al., "Isolation of tumor cell-specific single-chain Fv from immunized mice using phage-antibody libraries and the re-construction of whole antibodies from these antibody fragments," *Eur. J. Immunol.*, 24: 952-958 (1994).
Kim and Moalem-Taylor, "Interleukin-17 Contributes to Neuroinflammation and Neuropathic Pain Following Peripheral Nerve Injury in Mice," *J. Pain*, 12(3): 370-383 (2010).
Kim et al., "Identifying amino acid residues that influence plasma clearance of murine IgG1 fragments by site-directed mutagenesis," *Eur. J. Immunol.*, 24: 542-548 (1994).
Kipriyanov et al., "Bispecific CD3×CD19 Diabody for T Cell-Mediated Lysis of Malignant Human B Cells," *Int. J. Cancer*, 77: 763-772 (1998).
Kipriyanov et al., "Generation of recombinant antibodies," *Mol. Biotechnol.*, 12: 173-201 (1999).
Klein, W.L., "Aβ toxicity in Alzheimer's disease: Globular oligomers (ADDLs) as new vaccine and drug targets," *Neurochem. Int.*, 41: 345-352 (2002).
Klyubin et al., "Amyloid β protein immunotherapy neutralizes Aβ oligomers that disrupt synaptic plasticity in vivo," *Nature Med.*, 11: 556-561 (2005).
Köhler and Milstein, "Continuous cultures of fused cells secreting antibody of predefined specificity," *Nature*, 256: 495-497 (1975).
Konishi et al., "A simple and sensitive bioassay for the detection of human interleukin-18/ interferon-γ-inducing factor using human myelomonocytic KG-1 cells," *J. Immunol. Methods*, 209: 187-191 (1997).
Kontermann, R.E., "Recombinant bispecific antibodies for cancer therapy," *Acta Pharmacologica Sinica*, 26(1): 1-9 (2005).
Kostelny et al., "Formation of a Bispecific Antibody by the Use of Leucine Zippers," *J. Immunol.*, 148(5): 1547-1553 (1992).
Kou et al., "A bispecific antibody effectively inhibits tumor growth and metastasis by simultaneous blocking vascular endothelial growth factor A and osteopontin," *Cancer Lett.*, 299: 130-136 (2010).
Kriangkum et al., "Bispecific and bifunctional single chain recombinant antibodies," *Biomol. Eng.*, 18: 31-40 (2001).
Krop et al., "Self-renewal of B-1 lymphocytes is dependent on CD19," *Eur. J. Immunol.*, 26: 238-242 (1996).
Kuby, *Immunology*, 2nd ed., (W.H. Freeman and Company, New York, 1994), p. 115, Fig. 5-6 (1 page).
Kurokawa et al., "Isoform-specific binding of selenoprotein P to the β-propeller domain of apolipoprotein E receptor 2 mediates selenium supply," *J. Biol. Chem.*, 289(13): 9195-9207 (2014).
Kwong et al., "Generation, affinity maturation, and characterization of a human anti-human NKG2D monoclonal antibody with dual antagonistic and agonistic activity," *J. Mol. Biol.*, 384(5): 1143-1156 (2008).
Kyte et al., "A Simple Method for Displaying the Hydropathic Character of a Protein," *J. Mol. Biol.*, 157: 105-132 (1982).
Lajoie, S. et al., "Complement-mediated regulation of the IL-17A axis is a central genetic determinant of the severity of experimental allergic asthma," *Nat. Immunol.*, 11(10): 928-935 (Oct. 2010).

Lam et al., "Microencapsulation of Recombinant Humanized Monoclonal Antibody for Local Delivery," *Proceed. Intl. Symp. Control Rel. Bioact. Mater.*, 24: 759-760 (1997).
Langer and Peppas, "Chemical and Physical Structure of Polymers as Carriers for Controlled Release of Bioactive Agents: A Review," *J. Macromol. Sci. RMC*, C23(1): 61-126 (1983).
Langer, R., "New Methods of Drug Delivery," *Science*, 249: 1527-1533 (1990).
Laue, T., "Analytical centrifugation: equilibrium approach," In *Current Protocols in Protein Science*, (John Wiley & Sons, Inc., New York, 1999), Supplement 18, Unit 20.3, pp. 20.3.1-20.3.13 (13 pages).
Lazarovici et al., "Cross Talk between the Cardiovascular and Nervous Systems: Neurotrophic Effects of Vascular Endothelial Growth Factor (VEGF) and Angiogenic Effects of Nerve Growth Factor (NGF)-Implications in Drug Development," *Curr. Pharmaceut. Des.*, 12:2609-2622 (2006).
Le Gall et al., "Di-, tri- and tetrameric single chain Fv antibody fragments against human CD19: Effect of valency on cell binding," *FEBS Letters*, 453: 164-168 (1999).
Le Gall et al., "Immunosuppressive properties of anti-CD3 single-chain Fv and diabody," *J. Immunol. Methods*, 285: 111-127 (2004).
Lee et al., "BiP and immunoglobulin light chain cooperate to control the folding of heavy chain and ensure the fidelity of immunoglobulin assembly," *Mol. Biol. Cell*, 10: 2209-2219 (1999).
Lee et al., "Treatment of rheumatoid arthritis (RA) with thalidomide," (Abstract No. 1524), *Arthritis Rheum.*, 39(9 Suppl.): S282 (1996) (1 page).
Legros et al., "Characterization of an anti-*Borrelia burgdorferi* OspA conformational epitope by limited proteolysis of monoclonal antibody-bound antigen and mass spectrometric peptide mapping," *Protein Science*, 9: 1002-1010 (2000).
Leung et al., "Vascular Endothelial Growth Factor Is a Secreted Angiogenic Mitogen," *Science*, 246(4935): 1306-1309 (1989).
Leung et al., "Combined Effects of IL-12 and IL-18 on the Induction of Collagen-Induced Arthritis," *J. Immunol.*, 164(12): 6495-6502 (2000).
Levites et al., "Insights into the mechanisms of action of anti-Aβ antibodies in Alzheimer's disease mouse models," *FASEB J.*, 20(14): 2576-2578 (2006).
Levy et al., "Inhibition of Calcification of Bioprosthetic Heart Valves by Local Controlled-Release Diphosphonate," *Science*, 228: 190-192 (1985).
Li et al., "Structural mutations in the constant region of the T-cell antigen receptor (TCR)β chain and their effect on TCRα and β chain interaction," *Immunology*, 88: 524-530 (1996).
Li et al., "Genetically engineered brain drug delivery vectors: Cloning, expression and in vivo application of an anti-transferrin receptor single chain antibody-streptavidin fusion gene and protein," *Protein Eng.*, 12(9): 787-796 (1999).
Li et al., "Synergistic effects of IL-12 and IL-18 in skewing tumor-reactive T-cell responses towards a type I pattern," *Cancer Res.*, 65(3): 1063-1070 (2005).
Li et al., "Bispecific Antibody to ErbB2 Overcomes Trastuzumab Resistance through Comprehensive Blockade of ErbB2 Heterodimerization," *Cancer Res.*, 73(21): 6471-6483 (2013).
Little et al., "Of mice and men: hybridoma and recombinant antibodies," *Immunol. Today*, 21(8): 364-370 (2000).
Liu et al., "Heterogeneity of Monoclonal Antibodies," *J. Pharm. Sci.*, 97(7): 2426-2447 (2008).
Lloyd et al., "Mouse Models of Allergic Airway Disease," *Adv. Immunol.*, 77: 263-295 (2001).
Lo, B., "Antibody Humanization by CDR Grafting," *Methods Mol. Biol.*, 248: 135-159 (2004).
Lobo et al., "Application of anti-methotrexate Fab fragments for the optimization of intraperitoneal methotrexate therapy in a murine model of peritoneal cancer," *J. Pharma. Sci.*, 94(9): 1957-1964 (2005) (Abstract only) (1 page).
Lobo, "Anti-Methotrexate Fab Fragments for Optimization of Intraperitoneal Methotrexate Chemotherapy," Dissertation, University of New York at Buffalo, Dept. of Pharmaceutical Sciences, Aug. 2002, pp. 1-243. Available online at: http://www.acsu.buffalo.edu/~jb/Thesis%20080802.pdf.

(56) References Cited

OTHER PUBLICATIONS

Lotz et al., "IL-17 promotes cartilage degradation," (Abstract No. 559), *Arthritis Rheum.*, 39(9 Suppl.): S120 (1996) (1 page).
Lu et al., "A Fully Human Recombinant IgG-like Bispecific Antibody to Both the Epidermal Growth Factor Receptor and the Insulin-like Growth Factor Receptor for Enhanced Antitumor Activity," *J. Biol. Chem.*, 280(20): 19665-19672 (2005).
Lu et al., "Di-diabody: A novel tetravalent bispecific antibody molecule by design," *J. Immunol. Methods*, 279: 219-232 (2003).
Lu et al., "Fab-scFv fusion protein: an efficient approach to production of bispecific antibody fragments," *J. Immunol. Methods*, 267: 213-226 (2002).
Lu et al., "Simultaneous Blockade of Both the Epidermal Growth Factor Receptor and the Insulin-like Growth Factor Receptor Signaling Pathways in Cancer Cells with a Fully Human Recombinant Bispecific Antibody," *J. Biol. Chem.*, 279(4): 2856-2865 (2004).
Lublin, F.D., "Relapsing Experimental Allergic Encephalomyelitis. An Autoimmune Model of Multiple Sclerosis," *Springer Semin. Immunopathol.*, 8: 197-208 (1985).
Lund et al., "Human Fc gamma RI and Fc gamma RII interact with distinct but overlapping sites on human IgG," *J. Immunol.*, 147: 2657-2662 (1991).
Luster et al., "Use of animal studies in risk assessment for immunotoxicology," *Toxicology*, 92(1-3): 229-243 (1994).
MacCallum et al., "Antibody-antigen Interactions: Contact Analysis and Binding Site Topography," *J. Mol. Biol.*, 262: 732-745 (1996).
Mack et al., "A small bispecific antibody construct expressed as a functional single-chain molecule with high tumor cell cytotoxicity," *Proc. Natl. Acad. Sci. USA*, 92: 7021-7025 (1995).
Madhusudan et al., "A phase II study of etanercept (Enbrel), a tumor necrosis factor alpha inhibitor in patients with metastatic breast cancer," *Clin. Cancer Res.*, 10(19): 6528-6534 (2004).
Makwana et al., "Molecular mechanisms in successful peripheral regeneration," *FEBS J.*, 272: 2628-2638 (2005).
Malfait et al., "ADAMTS-5 deficient mice do not develop mechanical allodynia associated with osteoarthritis following medial meniscal destabilization," *Osteoarthritis Cartilage*, 18: 572-580 (2010).
Malik-Hall et al., "Primary afferent nociceptor mechanisms mediating NGF-induced mechanical hyperalgesia," *Eur. J. Neurosci.*, 21(12): 3387-3394 (2005).
Mansikka et al., "Safety, Tolerability, and Functional Activity of ABT-122, a Dual TNF- and IL-17a—Targeted DVD-Ig™, Following Single-Dose Administration in Healthy Subjects," *Ann. Rheum. Dis.*, 74(Suppl. 2):482-483 (2015).
Marchalonis et al., "Evolutionary Factors in the Emergence of the Combinatorial Germline Antibody Repertoire," *Adv. Exp. Med. Biol.*, 484: 13-30 (2001).
Margolin et al., "Protein crystals as novel catalytic materials," *Angew. Chem. Int. Ed.*, 40: 2204-2222 (2001).
Mariuzza et al., "The Structural Basis of Antigen-Antibody Recognition," *Annu. Rev. Biophys. Biophys. Chem.*, 16: 139-159 (1987).
Marks et al., "By-Passing Immunization: Building High Affinity Human Antibodies by Chain Shuffling," *Bio Technology*, 10: 779-783 (1992).
Marques et al., "Mediation of the Cytokine Network in the Implantation of Orthopedic Devices," Chapter 21, In *Biodegradable Systems in Tissue Engineering and Regenerative Medicine*, (Reis et al., eds.) (CRC Press LLC, Boca Raton, 2005) pp. 377-397.
Marquina et al., "Inhibition of B cell death causes the development of an IgA nephropathy in (New Zealand White x C57BL/6)F1-bcl-2 transgenic mice," *J. Immunol.*, 172(11): 7177-7185 (2004).
Martin, A.C.R., "Protein Sequence and Structure Analysis of Antibody Variable Domains," Chapter 31, In *Antibody Engineering*. (Kontermann and Dübel, eds.), (Springer-Verlag, Berlin, 2001), pp. 422-439.
Martin et al., "The Emerging Role of IL-17 in the Pathogenesis of Psoriasis: Preclinical and Clinical Findings," *J. Invest. Dermatol.*, 133: 17-26 (2013).
Marvin and Zhu, "Recombinant approaches to IgG-like bispecific antibodies," *Acta Pharmacologica Sinica*, 26(6): 649-658 (2005).

Masliah et al., "Effects of α-Synuclein Immunization in a Mouse Model of Parkinson's Disease," *Neuron*, 46: 857-868 (2005).
Mateo et al., "Humanization of a mouse monoclonal antibody that blocks the epidermal growth factor receptor: recovery of antagonistic activity," *Immunotechnology*, 3: 71-81 (1997).
McCafferty et al., "Phage antibodies: Filamentous phage displaying antibody variable domains," *Nature*, 348: 552-554 (1990).
McDonnell et al., "TNF Antagonism," In *New Drugs for Asthma, Allergy and COPD. Prog Respir Res.*, vol. 31. (Hansel et al., eds.) (Karger, Basel, 2001) pp. 247-250.
McGee et al., "The Nogo-66 receptor: Focusing myelin inhibition of axon regeneration," *Trends in Neurosciences*, 26(4): 193-198 (2003).
McGuire-Goldring et al., "In Vitro Activation of Human Chondrocytes and Synoviocytes by a Human Interleukin-1-Like Factor," *Arthritis Rheum.*, 27(6): 654-662 (1984).
McIntosh et al., "In Vivo Induction of IL-6 by Administration of Exogenous Cytokines and Detection of De Novo Serum Levels of IL-6 in Tumor-Bearing Mice," *J. Immunol.*, 143(1): 162-167 (1989).
McMahon et al., "Does Anti-TNF-Alpha Have a Role in the Treatment of Osteoporosis?" *Bulletin of the NYU Hospital for Joint Diseases*, 66: 280-281 (2008).
Mendez et al., "Functional transplant of megabase human immunoglobulin loci recapitulates human antibody response in mice," *Nature Genet.*, 15: 146-156 (1997).
Merchant et al., "An efficient route to human bispecific IgG," *Nature Biotechnol.*, 16: 677-681 (1998).
Metz et al., "Bispecific antibody derivatives with restricted binding functionalities that are activated by proteolytic processing," *Prot. Engin. Des. Sel.*, 25(10): 571-580 (2012).
Michaelson, J., "Dual Targeting of TNF and TWEAK in Inflammatory Bowel Disease: The Promise of a Bispecific Antibody," Conference, Cytokines & Inflammation, Jan. 28, 2011; Agenda, p. 11. Retrieved from the Internet: http://www.cytokinesandinflammation.com/Index.php?option=com_content&view=article&id=50&itemid=54.
Miller et al., "Design, Construction, and In Vitro Analyses of Multivalent Antibodies," *J. Immunol.*, 170: 4854-4861 (2003).
Milstein et al., "Hybrid hybridomas and their use in immunohistochemistry," *Nature*, 305: 537-540 (1983).
Miossec et al., "Targeting IL-17 and TH17 cells in chronic inflammation," *Nat. Rev. Drug. Disc.*, 11(10): 763-776 (2012).
Mizushima et al., "pEF-BOS, a powerful mammalian expression vector," *Nucl. Acids Res.*, 18(17): 5322 (1990).
Mnich et al., "Characterization of a monoclonal antibody that neutralizes the activity of prostaglandin $E_2$," *J. Immunol.*, 155: 4437-4444 (1995).
Modjtahedi et al., "Antitumor Activity of Combinations of Antibodies Directed Against Different Epitopes on the Extracellular Domain of the Human EGF Receptor," *Cell Biophys.*, 22(1-3): 129-146 (1993).
Modjtahedi et al., "Phase I trial and tumour localisation of the anti-EGFR monoclonal antibody 1CR62 in head and neck or lung cancer," *Br. J. Cancer*, 73: 228-235 (1996).
Modjtahedi et al., "Targeting of Cells Expressing Wild-Type EGFR and Type-III Mutant EGFR (EGFRVIII) by Anti-EGFR MAB ICR62: A Two-Pronged Attack for Tumour Therapy," *Int. J. Cancer*, 105: 273-280 (2003).
Modjtahedi et al., "The human EGF receptor as a target for cancer therapy: Six new rat mAbs against the receptor on the breast carcinoma MDA-MB 468," *Br. J. Cancer*, 67: 247-253 (1993).
Motoi et al., "Apolipoprotein E receptor 2 is involved in neuritic plaque formation in APP sw mice," *Neurosci. Lett.*, 368: 144-147 (2004).
Monnet et al., "Association between the IL-1 family gene cluster and spondyloarthritis," *Ann. Rheum. Dis.*, 71: 885-890 (2012).
Moreland et al., "Soluble tumor necrosis factor receptors (sTNFR): Results of a phase I dose-escalation study in patients with rheumatoid arthritis," (Abstract No. 813), *Arthritis Rheum.*, 37: S295 (1994) (1 page).
Morgan and Anderson, "Human Gene Therapy," *Ann. Rev. Biochem.*, 62: 191-217 (1993).

(56) References Cited

OTHER PUBLICATIONS

Morgan et al., "Dissociation of hyperalgesia from fever following intracerebroventricular administration of interleukin-1β in the rat," *Brain Res.*, 1022(1-2): 96-100 (2004).

Morimoto et al., "The Increased Interleukin-13 in Patients with Systemic Lupus Erythematosus: Relations to Other Th1-, Th2-Related Cytokines and Clinical Findings," *Autoimmunity*, 34(1): 19-25 (2001).

Moriuchi et al., "Treatment of established collagen-induced arthritis with PGE1 incorporated in lipid microspheres," (Abstract No. 1528), *Arthritis Rheum.*, 39(9 Suppl.): S282 (1996) (1 page).

Morrison and Schlom, "Recombinant Chimeric Monoclonal Antibodies," Chapter 1, In *Important Advances in Oncology 1990* (J.B. Lippincott Company, Philadelphia, 1990), pp. 3-18.

Morrison et al., "Genetically Engineered Antibody Molecules," *Advances in Immunology*, 44: 65-92 (1989).

Morrison, S., "Two heads are better than one," *Nature Biotech.*, 25(11): 1233-1234 (2007).

Müller et al., "The first constant domain ($C_H1$ and $C_L$) of an antibody used as heterodimerization domain for bispecific miniantibodies," *FEBS Lett.*, 422: 259-264 (1998).

Mulligan, R.C., "The Basic Science of Gene Therapy," *Science*, 260: 926-932 (1993).

Mullinax et al., "Expression of a Heterodimeric Fab Antibody Protein in One Cloning Step," *BioTechniques*, 12(6): 864-869 (1992).

Murthy et al., "Binding of an Antagonistic Monoclonal Antibody to an Intact and Fragmented EGF-Receptor Polypeptide," *Arch. Biochem. Biophys.*, 252(2): 549-560 (1987).

Myant, "Reelin and apolipoprotein E receptor 2 in the embryonic and mature brain: effects of an evolutionary change in the apoER2 gene," *Proc. R. Soc. B*, 277: 345-351 (2010).

Nakanishi et al., "Interleukin-18 Regulates Both TH1 and TH2 Responses," *Ann. Rev. Immunol.*, 19: 423-474 (2001).

Nalbandian et al., "Interleukin-17 and systemic lupus erythematosus: current concepts," *Clin. Exp. Immunol.*, 157(2): 209-215 (2009).

National Center for Biotechnology Information (NCBI), GenPept Database, "General transcription factor II-I repeat domain-containing protein 1 isoform e [Mus musculus]," Accession No. NP_001074935, ROD Feb. 15, 2015 [online]. Retrieved from the Internet: http://www.ncbi.nlm.nih.gov/protein/NP_001074935 (3 pages).

National Center for Biotechnology Information (NCBI), GenPept Database, "Low-density lipoprotein receptor-related protein 8 isoform 1 precursor [*Homo sapiens*]," Accession No. NP_004622, PRI Nov. 15, 2015 [online]. Retrieved from the Internet: http://www.ncbi.nlm.nih.gov/protein/NP_004622 (7 pages).

National Center for Biotechnology Information (NCBI), GenPept Database, "Low-density lipoprotein receptor-related protein 8 isoform 3 precursor [*Homo sapiens*]," Accession No. NP_059992, PRI Nov. 15, 2015 [online]. Retrieved from the Internet: http://www.ncbi.nlm.nih.gov/protein/NP_059992 (5 pages).

National Center for Biotechnology Information (NCBI), Protein Database, "Chain H, Vascular Endothelial Growth Factor in Complex with a Neutralizing Antibody," Accession No. 1BJ1_H, ROD Jun. 30, 1998 [online]. Retrieved from the Internet: http://www.ncbi.nlm.nih.gov/protein/1BJ1_H (3 pages).

National Center for Biotechnology Information (NCBI), Protein Database, "Chain L, Vascular Endothelial Growth Factor in Complex with a Neutralizing Antibody," Accession No. 1BJ1_L, ROD Jun. 30, 1998 [online]. Retrieved from the Internet: http://www.ncbi.nlm.nih.gov/protein/4389276?sat=11&satkey=3623907 (3 pages).

National Center for Biotechnology Information (NCBI), Protein Database, "Chain H, Structure of the G6 Fab, a Phage Derived Vegf Binding Fab," Accession No. 2FJF_H, PRI Jan. 2, 2006 [online]. Retrieved from the Internet: http://www.ncbi.nlm.nih.gov/protein/90109456?sat=34&satkey=11061854 (2 pages).

National Center for Biotechnology Information (NCBI), Protein Database, "Chain L, Structure of the G6 Fab, a Phage Derived Vegf Binding Fab," Accession No. 2FJF_L, PRI Jan. 2, 2006 [online]. Retrieved from the Internet: http://www.ncbi.nlm.nih.gov/protein/90109455?sat=34&satkey=11061854 (2 pages).

National Center for Biotechnology Information (NCBI), Protein Database, "Chain H, Structure of the B20-4 Fab, a Phage Derived Fab Fragment, in Complex with Vegf," Accession No. 2FJH_H, PRI Jan. 2, 2006 [online]. Retrieved from the Internet: http://www.ncbi.nlm.nih.gov/protein/90109487?sat=34&satkey=11061856 (2 pages).

National Center for Biotechnology Information (NCBI), Protein Database, "Chain L, Structure of the B20-4 Fab, a Phage Derived Fab Fragment, in Complex with Vegf," Accession No. 2FJH_L, PRI Jan. 2, 2006 [online]. Retrieved from the Internet: http://www.ncbi.nlm.nih.gov/protein/90109486?sat=34&satkey=11061856 (2 pages).

Nelson, R.B. "The Dualistic Nature of Immune Modulation in Alzheimer's Disease: Lessons from the Transgenic Models," *Curr. Pharm. Des.*, 11: 3335-3352 (2005).

Neuman et al., "An ELISA for PGE2 utilizing monoclonal antibody," *J. Immunoassay & Immunochem.*, 9(2): 159-177 (1988).

Ning et al., "Intratumoral radioimmunotherapy of a human colon cancer xenograft using a sustained-release gel," *Radiotherapy Oncol.*, 39: 179-189 (1996).

Nishida et al., "Angiogenesis in cancer" *Vascular Health and Risk Management*, 2(3):213-219 (2006).

Nishimoto et al., "Treatment of rheumatoid arthritis with humanized anti-interleukin-6 receptor antibody," *Arthritis Rheum.*, 50(6): 1761-1769 (2004).

O'Connor et al., "Requirement of multiple phage displayed peptide libraries for optimal mapping of a conformational antibody epitope on CCR5," *J. Immunol. Methods*, 299: 21-35 (2005).

Okamoto et al., "Rituximab for Rheumatoid Arthritis," *N. Engl. J. Med.*, 351: 1909 (2004) (1 page).

Onishi and Gaffen, "Interleukin-17 and its target genes: mechanisms of interleukin-17 function in disease," *Immunol.*, 129:311-321 (2010).

Owens et al., "The Immunology of Multiple Sclerosis and Its Animal Model, Experimental Allergic Encephalomyelitis," *Neurol. Clin.*, 13(1): 51-73 (1995).

Pack and Plückthun, "Miniantibodies: Use of Amphipathic Helices to Produce Functional, Flexibly Linked Dimeric $F_v$ Fragments with High Avidity in *Escherichia coli*," *Biochemistry*, 31: 1579-1584 (1992).

Padilla et al., "IL-13 Regulates the Immune Response to Inhaled Antigens," *J. Immunol.*, 174(12): 8097-8105 (2005).

Padlan et al., "Identification of specificity-determining residues in antibodies," *FASEB J.*, 9: 133-139 (1995).

Padlan, E.A., "A Possible Procedure for Reducing the Immunogenicity of Antibody Variable Domains While Preserving Their Ligand-Binding Properties," *Mol. Immunol.*, 28(4/5): 489-498 (1991).

Pardridge, "Blood-brain barrier delivery of protein and non-viral gene therapeutics with molecular Trojan horses," *J. Control Release*, 122(3): 345-348 (2007).

Pardridge, "Biologic TNFα-inhibitors that cross the human blood-brain barrier," *Bioengineered Bugs*, 1(4): 231-234 (2010).

Parikh et al., "Urine NGAL and IL-18 are predictive biomarkers for delayed graft function following kidney transplantation," *Am. J. Transplant.*, 6(7): 1639-1645 (2006).

Park and Lee, "Interleukin-17 regulation: an attractive therapeutic approach for asthma," *Respir. Res.*, 11: 78 (2010).

Park et al., "Generation and characterization of a novel tetravalent bispecific antibody that binds to hepatitis B virus surface antigens," *Molecular Immunol.*, 37: 1123-1130 (2000).

Pearlman and Nguyen, "Analysis of protein drugs," Chapter 6, In *Peptide and Protein Drug Delivery. Advances in Parenteral Sciences*, vol. 4. 1st ed. (Lee, ed.) (Marcel Dekker, Inc., New York, 1991), pp. 247-301.

Peipp et al., "Bispecific antibodies targeting cancer cells," *Biochem. Soc. Trans.*, 30(4): 507-511 (2002).

(56) References Cited

OTHER PUBLICATIONS

Pelletier et al., "In Vivo Suppression of Early Experimental Osteoarthritis by Interleukin-1 Receptor Antagonist Using Gene Therapy," *Arthritis Rheum.*, 40(6): 1012-1019 (1997).
Peng et al., "Experimental Use of Murine Lupus Models," *Methods Mol. Med.*, 102: 227-272 (2004).
Persic et al., "An integrated vector system for the eukaryotic expression of antibodies or their fragments after selection from phage display libraries," *Gene*, 187: 9-18 (1997).
Petkova et al., "Enhanced half-life of genetically engineered human IgG1 antibodies in a humanized FcRn mouse model: Potential application in humorally mediated autoimmune disease," *Int. Immunol.*, 18: 1759-1769 (2006).
Petrey et al., "Using multiple structure alignments, fast model building, and energetic analysis in fold recognition and homology modeling," *Proteins*, 53: 430-435 (2003).
Pettiphar et al., "Interleukin 1 induces leukocyte infiltration and cartilage proteoglycan degradation in the synovial joint," *Proc. Natl. Acad. Sci. USA*, 83: 8749-8753 (1986).
Pham, V. et al., "De novo proteomic sequencing of a monoclonal antibody raised against OX40 ligand," *Analytical Biochemistry*, 352: 77-86 (2006).
Piatesi et al., "Immunological Optimization of a Generic Hydrophobic Pocket for High Affinity Hapten Binding and Diels-Alder Activity," *ChemBioChem*, 5: 460-466 (2004).
Pimm et al., "A bispecific monoclonal antibody against methotrexate and a human tumour associated antigen augments cytotoxicity of methotrexate-carrier conjugate," *Br. J. Cancer*, 61: 508-513 (1990).
PIR (Protein Information Resource) Accession No. PC4203, "Ig kappa chain (monoclonal antibody MabA34)—mouse (fragment)," Jan. 11, 2000 (2 pages).
Plückthun et al., "New protein engineering approaches to multivalent and bispecific antibody fragments," *Immunotechnology*, 3: 83-105 (1997).
Poljak, R.J., "Production and structure of diabodies," *Structure*, 2: 1121-1123 (1994).
Portanova et al., "Selective Neutralization of Prostaglandin $E_2$ Blocks Inflammation, Hyperalgesia, and Interleukin 6 Production In Vivo," *J. Exp. Med.*, 184(3): 883-891 (1996).
Portolano et al., "Lack of promiscuity in autoantigen-specific H and L chain combinations as revealed by human H and L chain 'roulette,'" *J. Immunol.*, 150: 880-887 (1993).
Presta et al., "Humanization of an Antibody Directed Against IgE," *J. Immunol.*, 151(5): 2623-2632 (1993).
Presta, L.G., "Engineering of therapeutic antibodies to minimize immunogenicity and optimize function," *Adv. Drug. Del. Rev.*, 58: 640-656 (2006).
Presta, L.G., "Molecular engineering and design of therapeutic antibodies," *Curr. Opin. Immunol.*, 20: 460-470 (2008).
Presta, L.G., "Selection, design, and engineering of therapeutic antibodies," *J. Allergy Clin. Immunol.*, 116: 731-736 (2005).
Qi et al, "A bispecific antibody against IL-1β and IL-17A is beneficial for experimental rheumatoid arthritis," *Internat'l. Immunopharm.*, 14: 770-778 (2012).
Qu et al., "Bispecific anti-CD20/22 antibodies inhibit B-cell lymphoma proliferation by a unique mechanism of action," *Blood*, 111(4): 2211-2219 (2007).
Quesada et al., "Do Not Say Ever Never More: The Ins and Outs of Antiangiogenic Therapies," *Curr. Pharmaceut. Des.*, 16: 3932-3957 (2010).
Rahman et al., "Association between the interleukin-1 family gene cluster and psoriatic arthritis," *Arthritis Rheum.*, 54(7): 2321-2325 (2006).
Reichert, J.M., "Bispecific antibodies and ADCs. Once and future kings?" *mAbs*, 3(4): 329-330 (2011).
Remington: *The Science and Practice of Pharmacy*. $21^{st}$ ed.(Lippincott Williams & Wilkins, Philadelphia, 2005), pp. 745-747, 802-804, 838, 879-883, 889-890, and 1079-1082 (14 pages).
Reusch et al., "Anti-CD3 × Anti-Epidermal Growth Factor Receptor (EGFR) Bispecific Antibody Redirects T Cell Cytolytic Activity to EGFR-Positive Cancers In vitro and in an Animal Model," *Clin. Cancer Res.*, 12(1): 183-190 (2006).
Ridgway et al., "'Knobs-into-holes' engineering of antibody $C_H3$ domains for heavy chain heterodimerization," *Protein Eng.*, 9(7): 617-621 (1996).
Ridgway et al., "Inhibition of Dll4 signalling inhibits tumour growth by deregulating angiogenesis," *Nature*, 144(7122): 1083-1087 (2006).
Riechmann et al., "Reshaping human antibodies for therapy," *Nature*, 332: 323-327 (1988).
Riemer et al., "Matching of trastuzumab (Herceptin®) epitope mimics onto the surface of Her-2/neu—a new method of epitope definition" *Mol. Immunol.*, 42: 1121-1124 (2005).
Roberts et al., "RNA-peptide fusions for the in vitro selection of peptides and proteins," *Proc. Natl. Acad. Sci. USA*, 94: 12297-12302 (1997).
Robinson, C., "Gene therapy—proceeding from laboratory to clinic," *Trends Biotechnol.*, 11(5): 155 (1993) (1 page).
Rodeck et al., "Interactions Between Growth Factor Receptors and Corresponding Monoclonal Antibodies in Human Tumors," *J. Cell Biochem.*, 35: 315-320 (1987).
Roguska et al., "A comparison of two murine monoclonal antibodies humanized by CDR-grafting and variable domain resurfacing," *Protein Eng.*, 9(10): 895-904 (1996).
Roguska et al., "Humanization of murine monoclonal antibodies through variable domain resurfacing," *Proc. Natl. Acad. Sci. USA*, 91: 969-973 (1994).
Romon et al., "Nerve growth factor promotes breast cancer angiogenesis by activating multiple pathways," *Mol. Cancer*, [online] 9:157 (13 pages) (Jun. 2010). Retrieved from the Internet: http://rd.springer.com/content/pdf/10.1186/1476-4598-9-157.pdf; retrieved on Jul. 1, 2015.
Ronday et al., "Tranexamic acid (TEA), an inhibitor of plasminogen activation, reduces collagen crosslink excretion in arthritis," (Abstract No. 1541), *Arthritis Rheum.*, 39(9 Suppl.): S284 (1996) (1 page).
Ross, J.M., "Sulfasalazine (SSZ) toxicity: An assessment of American College of Rheumatology (ACR) monitoring guidelines for SSZ," (Abstract No. 1520), *Arthritis Rheum.*, 39(9 Suppl.): S281 (1996) (1 page).
Rudikoff et al., "Single amino acid substitution altering antigen-binding specificity," *Proc. Natl. Acad. Sci. USA*, 79: 1979-1983 (1982).
Sainson et al., "Anti-DII4 therapy: can we block tumour growth by increasing angiogenesis?" *Trends Mol. Med.*, 13(9): 389-395 (2007).
Sambrook and Russell (eds.), *Molecular Cloning: A Laboratory Manual*. $3^{rd}$ Ed. Cold Spring Harbor Laboratory Press, Cold Spring Harbor, NY, 2001; pp. 1.10-1.15, 1.84-1.87, 8.18-8.24, 15.54-15.59, and 16.47-16.55 (18 pages).
Santos et al., "Generation and Characterization of a Single Gene-encoded Single-Chain-Tetravalent Antitumor Antibody," *Clin. Cancer Res.*, 5 (Suppl.): 3118s-3123s (1999).
Satoh et al., "Non-fucosylated therapeutic antibodies as next-generation therapeutic antibodies," *Expert Opin. Biol. Ther.*, 6(11): 1161-1173 (2006).
Saudek et al., "A Preliminary Trial of the Programmable Implantable Medication System for Insulin Delivery," *N. Engl. J. Med.*, 321: 574-579 (1989).
Sawai et al., "Direct Production of the Fab Fragment Derived From the Sperm Immobilizing Antibody Using Polymerase Chain Reaction and cDNA Expression Vectors," *Am. J. Reprod. Immunol.*, 34: 26-34 (1995).
Schaefer et al., "Immunoglobulin domain crossover as a generic approach for the production of bispecific IgG antibodies," *PNAS*, 108(27): 11187-11192 (2011).
Schier et al., "Identification of functional and structural amino-acid residues by parsimonious mutagenesis," *Gene*, 169: 147-155 (1996).
Scholz, P., "Inhibition of the production and effect of TNF-alpha by iloprost: possible impact for treatment of rheumatoid arthritis," (Abstract No. 336), *Arthritis Rheum.*, 39(9 Suppl.): S82 (1996).

(56) References Cited

OTHER PUBLICATIONS

Sefton, M.V., "Implantable Pumps," *CRC Crit. Rev. Biomed. Eng.*, 14(3): 201-240 (1987).
Seligmann et al., "Immunochemical Study of a Human Myeloma IgG1 Half Molecule," *Ann. Immunol.*, 129 C: 855-870 (1978).
Selkoe, "Clearing the brain's amyloid cobwebs," *Neuron*, 32(2): 177-180 (2001).
Sewell et al., "$DAB_{486}IL$-2 fusion toxin in refractory rheumatoid arthritis," *Arthritis Rheum.*, 36(9): 1223-1233 (Sep. 1993).
Sfikakis et al., "Rituximab anti-B-cell therapy in systemic lupus erythematosus: Pointing to the future," *Curr. Opin. Rheumatol.*, 17: 550-557 (2005).
Shalaby et al., "Development of Humanized Bispecific Antibodies Reactive with Cytotoxic Lymphocytes and Tumor Cells Overexpressing the HER2 Protooncogene," *J. Exp. Med.*, 175: 217-225 (1992).
Shapiro et al., "DNA Target Motifs of Somatic Mutagenesis in Antibody Genes," *Crit. Rev. Immunol.*, 22(3): 183-200 (2002).
Shen et al., "Principles and applicability of CSF sampling for the assessment of CNS drug delivery and pharmacodynamics," *Adv. Drug Deliv. Rev.*, 56(12): 1825-1857 (2004).
Shepherd et al., "Novel 'inflammatory plaque' pathology in presenilin-1 Alzheimer's disease," *Neuropathol. Appl. Neurobiol.*, 31: 503-511 (2005).
Shields et al., "Lack of Fucose on Human IgG1 N-Linked Oligosaccharide Improves Binding to Human FcγRIII and Antibody-dependent Cellular Toxicity," *J. Biol. Chem.*, 277(30): 26733-26740 (2002).
Shu et al., "Secretion of a single-gene-encoded immunoglobulin from myeloma cells," *Proc. Natl. Acad. Sci. USA*, 90: 7995-7999 (1993).
Shukla et al., "HER2 specific delivery of methotrexate by dendrimer conjugated anti-Her2 mAB," *Nanotechnology*, 19: 295102 (2008) (7 pages).
Simonovic et al., "Calcium coordination and pH Dependence of the Calcium Affinity of Ligand-Binding Repeat CR7 from the LRP. Comparison with Related Domains from the LRP and the LDL Receptor," *Biochemistry*, 40: 15127-15134 (2001).
Sims et al., "A Humanized CD18 Antibody Can Block Function without Cell Destruction," *J. Immunol.*, 151(4): 2296-2308 (1993).
Skerra et al., "Assembly of a Functional Immunoglobulin $F_v$ Fragment in *Escherichia coli*," *Science*, 240: 1038-1041 (1988).
Skripuletz et al., "Cortical demyelination is prominent in the murine cuprizone model and is strain-dependent," *Am. J. Physiol.*, 172(4): 1053-1061 (2008).
Smith and Morrison, "Recombinant Polymeric IgG: An Approach to Engineering More Potent Antibodies," *Bio/Technology*, 12: 683-688 (1994).
Snibson et al., "Airway remodelling and inflammation in sheep lungs after chronic airway challenge with house dust mite," *Clin. Exp. Allergy*, 35: 146-152 (2005).
Soloman, B., "Alzheimer's Disease and Immunotherapy," *Curr. Alzheimer. Res.*, 1: 149-163 (2004).
Song et al., "Antibody Mediated Lung Targeting of Long-Circulating Emulsions," *PDA J. Pharm. Sci. Technol.*, 50(6): 372-377 (1996).
Spiess et al., "Alternative molecular formats and therapeutic applications for bispecific antibodies," *Mol. Immunol.*, 67(2 Pt. A): 95-106 (2015).
Staerz et al., "Hybrid antibodies can target sites for attack by T cells," *Nature*, 314: 628-631 (1985).
Stamper et al., "Crystal structure of the B7-1/CTLA-4 complex that inhibits human immune responses," *Nature*, 410: 608-611 (2001).
Stancovski et al., "Mechanistic aspects of the opposing effects of monoclonal antibodies to the ERBB2 receptor on tumor growth," *Proc. Natl. Acad. Sci. USA*, 88: 8691-8695 (1991).
Steffen et al., "Basic studies on enzyme therapy of immune complex diseases" *Wien Klin. Wochenschr.*, 97(8): 376-385 (1985) (Abstract only) (1 page).
Steinman et al., "Virtues and pitfalls of EAE for the development of therapies for multiple sclerosis," *Trends Immunol.*, 26(11): 565-571 (2005).
Stickler et al., "CD4+ T-cell epitope determination using unexposed human donor peripheral blood mononuclear cells," *J. Immunotherapy*, 23: 654-660 (2000).
Stolk et al., "Are severe non-hematologic side-effects on azathioprine treatment caused by altered purine enzyme activities?" (Abstract No. 1522), *Arthritis Rheum.*, 39(9 Suppl.): S281 (1996) (1 page).
Streppel et al., "Focal application of neutralizing antibodies to soluble neurotrophic factors reduces collateral axonal branching after peripheral nerve lesion," *Eur. J. Neurosci.*, 15(8): 1327-1342 (2002).
Studnicka et al., "Human-engineered monoclonal antibodies retain full specific binding activity by preserving non-CDR complementarity-modulating residues," *Protein Eng.*, 7(6): 805-814 (1994).
'T Hart et al., "Suppression of Ongoing Disease in a Nonhuman Primate Model of Multiple Sclerosis by a Human-Anti-Human IL-12p40 Antibody," *J. Immunol.*, 175(7): 4761-4768 (2005).
Tabernero, "The Role of VEGF and EGFR Inhibition: Implications for Combining Anti-VEGF and Anti-EGFR Agents" *Mol. Cancer Res.*, 5(3):203-220 (2007).
Taiwan Patent Application No. 095130565: Taiwan Patent Office Search Report, dated Apr. 24, 2009.
Tan et al., "A bispecific antibody against two different epitopes on hepatitis B surface antigen has potent hepatitis B virus neutralizing activity," *mAbs*, 5(6): 946-955 (2013).
Tarsca et al. "Dual-Variable Domain Immunoglobulin (DVD-Ig™ Technology: A Versatile, Novel Format for the Next Generation of Dual-Targeting Biologics," Chapter 10 in *Bispecific Antibodies*. Roland E. Kontermann (ed.), Springer, New York, 2011; pp. 171-185.
Taylor et al., "A transgenic mouse that expresses a diversity of human sequence heavy and light chain immunoglobulins," *Nucl. Acids Res.*, 20: 6287-6295 (1992).
Teng et al., "Nogo Signaling and Non-Physical Injury-Induced Nervous System Pathology," *J. Neuroscience Research*, 79: 273-278 (2005).
Thies et al., "Folding and Association of the Antibody Domain $C_H3$: Prolyl Isomerization Preceeds Dimerization," *J. Mol. Biol.*, 293: 67-79 (1999).
Thompson et al., "Clustal W: improving the sensitivity of progressive multiple sequence alignment through sequence weighting, position-specific gap penalties and weight matrix choice," *Nucleic Acids Research*, 22(22): 4673-4680 (1994).
Thoss et al., "Immunomodulation of rat antigen-induced arthritis by leflunomide alone and in combination with cyclosporin A," *Inflamm. Res.*, 45: 103-107 (1996).
Thurston et al., "The Delta paradox: DLL4 blockade leads to more tumour vessels but less tumour growth," *Nat. Rev.: Cancer*, 7(5): 327-331 (2007).
Tol et al., "Chemotherapy, Bevacizumab, and Cetuximab in Metastatic Colorectal Cancer," *N. Engl. J. Med.*, 360(6): 563-572 (2009).
Tolstoshev, P., "Gene Therapy, Concepts, Current Trials and Future Directions," *Ann. Rev. Pharmacol. Toxicol.*, 32: 573-596 (1993).
Torisu et al., "Discovery of a new class of potent, selective, and orally active prostaglandin $D_2$ receptor antagonists," *Bioorg. Med. Chem.*, 12: 5361-5378 (2004).
Torres et al., "The Immunoglobulin Heavy Chain Constant Region Affects Kinetic and Thermodynamic Parameters of Antibody Variable Region Interactions with Antigen," *J. Biol. Chem.*, 282(18): 13917-13927 (May 2007).
Tuohy et al., "Spontaneous Regression of Primary Autoreactivity during Chronic Progression of Experimental Autoimmune Encephalomyelitis and Multiple Sclerosis," *J. Exp. Med.*, 189(7): 1033-1042 (1999).
Tzartos, "Epitope Mapping by Antibody Competition. Methodology and Evaluation of the Validity of the Technique," in *Methods in Molecular Biology*. vol. 66: Epitope Mapping Protocols, Humana Press Inc.; pp. 55-66 (1998).
U.S. Appl. No. 12/431,460, filed Apr. 28, 2009 by Ghayur et al.: Notice of Allowance, dated Jan. 8, 2015.

(56) References Cited

OTHER PUBLICATIONS

U.S. Appl. No. 12/431,460, filed Apr. 28, 2009 by Ghayur et al.: Final Office Action, dated Aug. 7, 2014.
U.S. Appl. No. 12/431,460, filed Apr. 28, 2009 by Ghayur et al.: Non-Final Office Action, dated Apr. 4, 2014.
U.S. Appl. No. 12/431,460, filed Apr. 28, 2009 by Ghayur et al.: Final Office Action, dated Nov. 2, 2011.
U.S. Appl. No. 12/431,460, filed Apr. 28, 2009 by Ghayur et al.: Non-Final Office Action, dated Mar. 16, 2011.
U.S. Appl. No. 12/477,668, filed Jun. 3, 2009 by Ghayur et al.: Notice of Allowance, dated Apr. 13, 2015.
U.S. Appl. No. 12/477,668, filed Jun. 3, 2009 by Ghayur et al.: Final Office Action, dated Oct. 14, 2014.
U.S. Appl. No. 12/477,668, filed Jun. 3, 2009 by Ghayur et al.: Non-Final Office Action, dated Mar. 10, 2014.
U.S. Appl. No. 12/477,668, filed Jun. 3, 2009 by Ghayur et al.: Final Office Action, dated May 3, 2012.
U.S. Appl. No. 12/477,668, filed Jun. 3, 2009 by Ghayur et al.: Non-Final Office Action, dated Sep. 8, 2011.
U.S. Appl. No. 12/477,711, filed Jun. 3, 2009 by Ghayur et al.: Notice of Allowance, dated Jan. 27, 2015.
U.S. Appl. No. 12/477,711, filed Jun. 3, 2009 by Ghayur et al.: Non-Final Office Action, dated Jul. 29, 2014.
U.S. Appl. No. 12/477,711, filed Jun. 3, 2009 by Ghayur et al.: Final Office Action, dated Feb. 7, 2014.
U.S. Appl. No. 12/477,711, filed Jun. 3, 2009 by Ghayur et al.: Non-Final Office Action, dated Jul. 17, 2013.
U.S. Appl. No. 12/477,711, filed Jun. 3, 2009 by Ghayur et al.: Final Office Action, dated Dec. 30, 2011.
U.S. Appl. No. 12/477,711, filed Jun. 3, 2009 by Ghayur et al.: Non-Final Office Action, dated Aug. 11, 2011.
U.S. Appl. No. 12/499,652, filed Jul. 8, 2009 by Ghayur et al.: Notice of Allowance, dated Apr. 10, 2014.
U.S. Appl. No. 12/499,652, filed Jul. 8, 2009 by Ghayur et al.: Final Office Action, dated Nov. 3, 2011.
U.S. Appl. No. 12/499,652, filed Jul. 8, 2009 by Ghayur et al.: Non-Final Office Action, dated May 10, 2011.
U.S. Appl. No. 12/605,094, filed Oct. 23, 2009 by Ghayur et al.: Final Office Action, dated Nov. 30, 2011.
U.S. Appl. No. 12/605,094, filed Oct. 23, 2009 by Ghayur et al.: Non-Final Office Action, dated Jun. 29, 2011.
U.S. Appl. No. 12/631,483, filed Dec. 4, 2009 by Jakob et al.: Non-Final Office Action, dated May 27, 2014.
U.S. Appl. No. 12/631,483, filed Dec. 4, 2009 by Jakob et al.: Final Office Action, dated Jul. 6, 2012.
U.S. Appl. No. 12/631,483, filed Dec. 4, 2009 by Jakob et al.: Non-Final Office Action, dated Nov. 23, 2011.
U.S. Appl. No. 12/771,871, filed Apr. 30, 2010 by Ghayur et al.: Non-Final Office Action, dated Apr. 15, 2014.
U.S. Appl. No. 12/771,871, filed Apr. 30, 2010 by Ghayur et al.: Final Office Action, dated May 28, 2013.
U.S. Appl. No. 12/771,871, filed Apr. 30, 2010 by Ghayur et al.: Non-Final Office Action, dated May 16, 2012.
U.S. Appl. No. 12/771,874, filed Apr. 30, 2010 by Ghayur et al.: Final Office Action, dated Nov. 12, 2013.
U.S. Appl. No. 12/771,874, filed Apr. 30, 2010 by Ghayur et al.: Non-Final Office Action, dated Apr. 18, 2013.
U.S. Appl. No. 12/771,874, filed Apr. 30, 2010 by Ghayur et al.: Non-Final Office Action, dated Sep. 7, 2012.
U.S. Appl. No. 12/846,317, filed Jul. 29, 2010 by Ghayur et al.: Final Office Action, dated Nov. 6, 2013.
U.S. Appl. No. 12/846,317, filed Jul. 29, 2010 by Ghayur et al.: Final Office Action, dated May 23, 2013.
U.S. Appl. No. 12/873,926, filed Sep. 1, 2010 by Ghayur et al.: Notice of Allowance, dated Jul. 24, 2013.
U.S. Appl. No. 12/873,926, filed Sep. 1, 2010 by Ghayur et al.: Final Office Action, dated Mar. 12, 2013.
U.S. Appl. No. 12/873,926, filed Sep. 1, 2010 by Ghayur et al.: Non-Final Office Action, dated Aug. 28, 2012.
U.S. Appl. No. 12/905,474, filed Oct. 15, 2010 by Ghayur et al.: Notice of Allowance, dated Jan. 10, 2014.
U.S. Appl. No. 12/905,474, filed Oct. 15, 2010 by Ghayur et al.: Non-Final Office Action, dated May 29, 2013.
U.S. Appl. No. 12/914,614, filed Oct. 28, 2010 by Ghayur et al.: Notice of Allowance, dated Jan. 10, 2014.
U.S. Appl. No. 12/914,614, filed Oct. 28, 2010 by Ghayur et al.: Non-Final Office Action, dated Jun. 6, 2013.
U.S. Appl. No. 13/167,323, filed Jun. 23, 2011 by Ghayur et al.: Final Office Action, dated Nov. 20, 2013.
U.S. Appl. No. 13/167,323, filed Jun. 23, 2011 by Ghayur et al.: Non-Final Office Action, dated Jun. 4, 2013.
U.S. Appl. No. 13/178,641, filed Jul. 8, 2011 by Ghayur et al.: Notice of Allowance, dated May 7, 2015.
U.S. Appl. No. 13/178,641, filed Jul. 8, 2011 by Ghayur et al.: Non-Final Office Action, dated Dec. 17, 2014.
U.S. Appl. No. 13/196,138, filed Aug. 2, 2011 by Ghayur et al.: Notice of Allowance, dated Jan. 16, 2014.
U.S. Appl. No. 13/196,138, filed Aug. 2, 2011 by Ghayur et al.: Non-Final Office Action, dated Nov. 27, 2012.
U.S. Appl. No. 13/217,937, filed Aug. 25, 2011 by Ghayur et al.: Notice of Allowance, dated Feb. 13, 2015.
U.S. Appl. No. 13/217,937, filed Aug. 25, 2011 by Ghayur et al.: Non-Final Office Action, dated Aug. 22, 2014.
U.S. Appl. No. 13/217,937, filed Aug. 25, 2011 by Ghayur et al.: Final Office Action, dated Mar. 20, 2013.
U.S. Appl. No. 13/217,937, filed Aug. 25, 2011 by Ghayur et al.: Non-Final Office Action, dated Sep. 6, 2012.
U.S. Appl. No. 13/286,707, filed Nov. 1, 2011 by Ghayur et al.: Examiner's Answer to Appeal Brief, filed Sep. 28, 2015.
U.S. Appl. No. 13/286,707, filed Nov. 1, 2011 by Ghayur et al.: Final Office Action, dated Aug. 29, 2014.
U.S. Appl. No. 13/286,707, filed Nov. 1, 2011 by Ghayur et al.: Non-Final Office Action, dated Jan. 29, 2014.
U.S. Appl. No. 13/286,707, filed Nov. 1, 2011 by Ghayur et al.: Final Office Action, dated Jul. 17, 2013.
U.S. Appl. No. 13/286,707, filed Nov. 1, 2011 by Ghayur et al.: Non-Final Office Action, dated Feb. 25, 2013.
U.S. Appl. No. 13/729,353, filed Dec. 28, 2012 by Ghayur et al.: Notice of Allowance, dated Dec. 22, 2015.
U.S. Appl. No. 13/729,353, filed Dec. 28, 2012 by Ghayur et al.: Non-Final Office Action, dated Jun. 2, 2015.
U.S. Appl. No. 13/729,564, filed Dec. 28, 2012 by Ghayur et al.: Notice of Allowance, dated Oct. 7, 2015.
U.S. Appl. No. 13/729,564, filed Dec. 28, 2012 by Ghayur et al.: Non-Final Office Action, dated Jun. 26, 2015.
U.S. Appl. No. 13/729,645, filed Dec. 28, 2012 by Hsieh et al.: Notice of Allowance, dated May 1, 2015.
U.S. Appl. No. 14/056,116, filed Oct. 17, 2013 by Ghayur et al.: Notice of Allowance, dated Oct. 23, 2015.
U.S. Appl. No. 14/068,976, filed Oct. 21, 2013 by Gu et al.: Notice of Allowance, dated Jun. 11, 2015.
U.S. Appl. No. 14/068,976, filed Oct. 21, 2013 by Gu et al.: Non-Final Office Action, dated Feb. 4, 2015.
U.S. Appl. No. 14/135,107, filed Dec. 19, 2013 by Ghayur et al.: Non-Final Office Action, dated Dec. 2, 2015.
U.S. Appl. No. 14/135,149, filed Dec. 19, 2013, by Ghayur et al.: Non-Final Office Action, dated Dec. 4, 2015.
U.S. Appl. No. 14/211,596, filed Mar. 14, 2014 by Ghayur et al.: Non-Final Office Action, dated May 10, 2016.
U.S. Appl. No. 14/211,604, filed Mar. 14, 2014 by Ghayur et al.: Notice of Allowance, dated Mar. 26, 2015.
U.S. Appl. No. 14/248,223, filed Apr. 8, 2014 by Ghayur et al.: Non-Final Office Action, dated Mar. 24, 2015.
U.S. Appl. No. 14/248,223, filed Apr. 8, 2014 by Ghayur et al.: Final Office Action, dated Jul. 22, 2015.
U.S. Appl. No. 14/301,305, filed Jun. 10, 2014 by Ghayur et al.: Final Office Action, dated Nov. 2, 2015.
U.S. Appl. No. 14/301,305, filed Jun. 10, 2014 by Ghayur et al.: Non-Final Office Action, dated May 29, 2015.
U.S. Appl. No. 14/301,546, filed Jun. 11, 2014 by Gu et al.: Notice of Allowance, dated Apr. 9, 2015.

(56) References Cited

OTHER PUBLICATIONS

U.S. Appl. No. 14/301,546, filed Jun. 11, 2014 by Gu et al.: Non-Final Office Action, dated Nov. 25, 2014.
U.S. Appl. No. 14/323,627, filed Jul. 3, 2014 by Ghayur et al.: Notice of Allowance, dated Dec. 8, 2014.
U.S. Appl. No. 14/332,087, filed Jul. 15, 2014 by Ghayur et al.: Non-Final Office Action, dated Sep. 15, 2016.
Umaña et al., "Engineered glycoforms of an antineuroblastoma IgG1 with optimized antibody-dependent cellular cytotoxic activity," *Nature Biotechnol.*, 17: 176-180 (1999).
Urlaub et al., "Isolation of Chinese hamster cell mutants deficient in dihydrofolate reductase activity," *Proc. Natl. Acad. Sci. USA*, 77: 4216-4220 (1980).
Vaccaro et al., "Divergent activities of an engineered antibody in murine and human systems have implications for therapeutic antibodies," *Proc. Natl. Acad. Sci. USA*, 103: 18709-18714 (2006).
Vajdos et al., "Comprehensive functional maps of the antigen-binding site of an anti-ErbB2 antibody obtained with shotgun scanning mutagenesis," *J. Mol. Biol.*, 320: 415-428 (2002).
Verhoeyen et al., "Reshaping Human Antibodies: Grafting an Antilysozyme Activity," *Science*, 239: 1534-1536 (1988).
Vincent et al., "Clinical associations of serum interleukin-17 in systemic lupus erythematosus," *Arthritis Res. Ther.*, 15: R97 (9 pages), (Aug. 23, 2013).
Voet et al. (Eds.), *Biochemistry*. John Wiley & Sons, Inc., 1999; p. 1100.
Voller et al., "Enzyme immunoassays with special reference to ELISA techniques," *J. Clin. Pathol.*, 31: 507-520 (1978).
Von Mehren et al., "Monoclonal Antibody Therapy for Cancer," *Ann. Rev. Med.*, 54: 343-369 (2003).
Wallick et al., "Glycosylation of a $V_H$ Residue of a Monoclonal Antibody Against $\alpha(1\rightarrow6)$ Dextran Increases Its Affinity for Antigen," *J. Exp. Med.*, 168: 1099-1109 (1988).
Wang et al., "Antibody Structure, Instability, and Formulation," *J. Pharm. Sci.*, 96(1): 1-26 (2007).
Wang, P. and X. Yang, "Neutralization Efficiency Is Greatly Enhanced by Bivalent Binding of an Antibody to Epitopes in the V4 Region and the Membrane-Proximal External Region within One Trimer of Human Immunodeficiency Virus Type 1 Glycoproteins" *J. Virol.*, 84(14): 7114-7123 (2010).
Ward et al., "Binding activities of a repertoire of single immunoglobulin variable domains secreted from *Escherichia coli*," *Nature*, 341: 544-546 (1989).
West Jr. et al., "Crystal Structure and Immunoglobulin G Binding Properties of the Human Major Histocompatibility Complex-Related Fc Receptor," *Biochemistry*, 39: 9698-9708 (2000).
Wileman et al., "Associations between Subunit Ectodomains Promote T Cell Antigen Receptor Assembly and Protect against Degradation in the ER," *J. Cell Biol.*, 122(1): 67-78 (1993).
Wing et al., "Ex-vivo whole blood cultures for predicting cytokine-release syndrome: Dependence on target antigen and antibody isotype," *Therapeutic Immunol.*, 2(4): 183-190 (1995).
Winkles, J., "The TWEAK-Fn14 cytokine-receptor axis: discovery, biology and therapeutic targeting," *Nature Reviews. Drug Disc.*, 7(5): 411-425 (2008).
Witkowski et al., "Interleukin-17: A mediator of inflammatory responses," *Cell. Mol. Life Sci.*, 61: 567-579 (2004).
Wong et al., "Hyperproduction of IL-23 and IL-17 in patients with systemic lupus erythematosus: Implications for Th17-mediated inflammation in autoimmunity," *Clin. Immunol.*, 127(3): 385-393 (2008).
Wooldridge et al., "Tricks with tetramers: How to get the most from multimeric peptide-MHC," *Immunology*, 126: 147-164 (2009).
Wright et al., "Antibody variable region glycosylation: Position effects on antigen binding and carbohydrate structure," *EMBO J.*, 10(10): 2717-2723 (1991).
Wu and Grainger, "Drug/device combinations for local drug therapies and infection prophylaxis," *Biomaterials*, 27: 2450-2467 (2006).
Wu and Wu, "Delivery systems for gene therapy," *Biotherapy*, 3: 87-95 (1991).
Wu and Wu, "Receptor-mediated in Vitro Gene Transformation by a Soluble DNA Carrier System," *J. Biol. Chem.*, 262(10): 4429-4432 (1987).
Wu et al., "Generation and Characterization of a Dual Variable Domain Immunoglobulin (DVD-Ig™) Molecule," in *Antibody Engineering*, vol. 2. R. Kontermann and S. Dübel (Eds.), Springer-Verlag, 2010; pp. 239-250.
Wu et al., "Humanization of a murine monoclonal antibody by simultaneous optimization of framework and CDR residues," *J. Mol. Biol.*, 294: 151-162 (1999).
Wu et al., "IL-18 receptor β-induced changes in the presentation of IL-18 binding sites affect ligand binding and signal transduction," *J. Immunol.*, 170: 5571-5577 (2003).
Wu et al., "Molecular construction and optimization of anti-human IL-1α/β dual variable domain immunoglobulin (DVD-Ig™) molecules," *mAbs*, 1(4): 339-347 (2009).
Wu et al., "Simultaneous targeting of multiple disease mediators by a dual-variable-domain immunoglobulin," *Nature Biotechnol.*, 25(11): 1290-1297 (2007).
Wu et al., "Simultaneous targeting of multiple disease mediators by a dual-variable-domain immunoglobulin," *Nature Biotechnology* (advance online publication, http://www.nature.com/naturebiotechnology), pp. 1-8 (published online Oct. 14, 2007).
Wu et al., "Tumor localization of anti-CEA single-chain Fvs: Improved targeting by non-covalent dimers," *Immunotechnology*, 2(1): 21-36 (1996).
Wurm, F.M., "Production of recombinant protein therapeutics in cultivated mammalian cells," *Nature Biotechnol.*, 22(11): 1393-1398 (2004).
Wynn et al., "Distinct roles for IL-13 and IL-17 in chronic inflammation and fibrosis," *J. Immunol.*, 184:134.8 (2010).
Xu et al., "Recombinant DNA vaccine encoding multiple domains related to inhibition of neurite outgrowth: A potential strategy for axonal regeneration," *J. Neurochem.*, 91: 1018-1023 (2004).
Yamada et al., "Aβ Immunotherapy: Intracerebral Sequestration of Aβ by an Anti-Aβ Monoclonal Antibody 266 with High Affinity to Soluble Aβ," *J. Neurosci.*, 29(36):11393-11398 (2009).
Yao et al., "Human IL-17: A Novel Cytokine Derived from T Cells," *J. Immunol.*, 155: 5483-5486 (1995).
Yao et al., "Molecular characterization of the human interleukin (IL)-17 receptor," *Cytokine*. 9(11): 794-800 (1997).
Yelton et al., "Affinity Maturation of the BR96 Anti-Carcinoma Antibody by Codon-Based Mutagenesis," *J. Immunol.*, 155: 1994-2004 (1995).
Yonehara et al., "Involvement of apoptosis antigen Fas in clonal deletion of human thymocytes," *Int. Immunol.*, 6(12): 1849-1856 (1994).
Yu et al., "Boosting Brain Uptake of a Therapeutic Antibody by Reducing Its Affinity for a Transcytosis Target," *Sci. Transl. Med.*, 3(84):84ra44, 8 pages (2011).
Zapata et al., "Engineering linear F(ab')$_2$ fragments for efficient production in *Escherichia coli* and enhanced antiproliferative activity," *Protein Eng.*, 8(10): 1057-1062 (1995).
Zhang and Pardridge, "Delivery of β-Galactosidase to Mouse Brain via the Blood-Brain Barrier Transferrin Receptor," *J. Pharmacol. Exper. Ther.*, 313(5): 1075-1081 (2005).
Zhang et al., "Direct chitosan-mediated gene delivery to the rabbit knee joints in vitro and in vivo," *Biochem. Biophys. Res. Commun.*, 341: 202-208 (2006).
Zhang et al., "Inhibition of Cyclooxygenase-2 Rapidly Reverses Inflammatory Hyperalgesia and Prostaglandin $E_2$ Production," *J. Pharmacol. Exp. Ther.*, 283(3): 1069-1075 (1997).
Zhou et al., "Neuroprotection with a Brain-Penetrating Biologic Tumor Necrosis Factor Inhibitor," *J. Pharmacol. Exp. Therapeut.*, 339(2): 618-623 (2011).
Zola et al., "CD Molecules 2005: Human cell differentiation molecules," *Blood*, 106: 3123-3126 (2005).
Zuo et al., "An efficient route to the production of an IgG-like bispecific antibody," *Protein Eng.*, 13(5): 361-367 (2000).

(56) References Cited

OTHER PUBLICATIONS

Digiammarino et al., "Design and Generation of DVD-Ig™ Molecules for Dual-Specific Targeting," *Methods in Molecular Biology*, 899: 145-156 (2012).

Inter Partes Reexamination (Control No. 95/001,380) of U.S. Pat. No. 7,612,181 (U.S. Appl. No. 11/507,050): Patent Board Decision Under 37 C.F.R. § 41.77(f), dated Apr. 3, 2017.

International Patent Application No. PCT/US2016/037710: International Search Report and Written Opinion, dated Jan. 11, 2017 (31 pages).

Kontermann, R.E. "Dual targeting strategies with bispecitic antibodies," *mAbs*, 4(2): 182-197 (2012).

\* cited by examiner

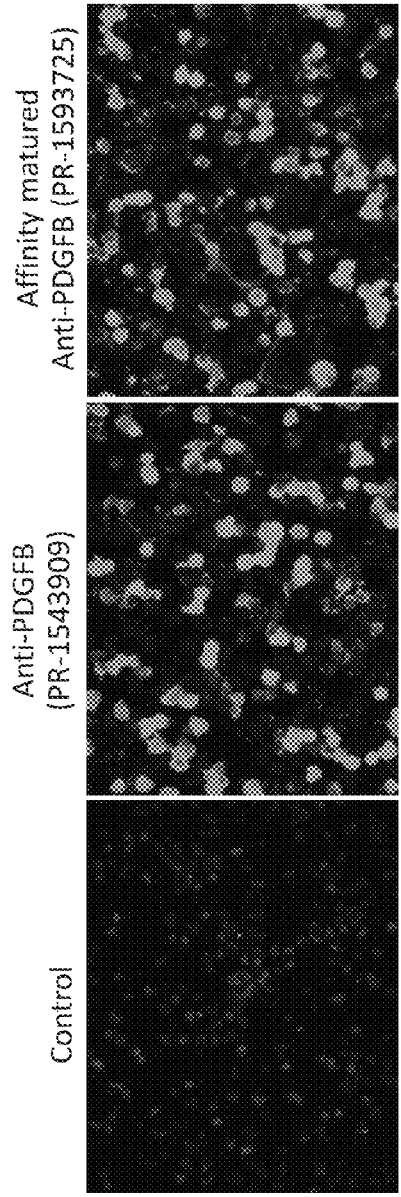
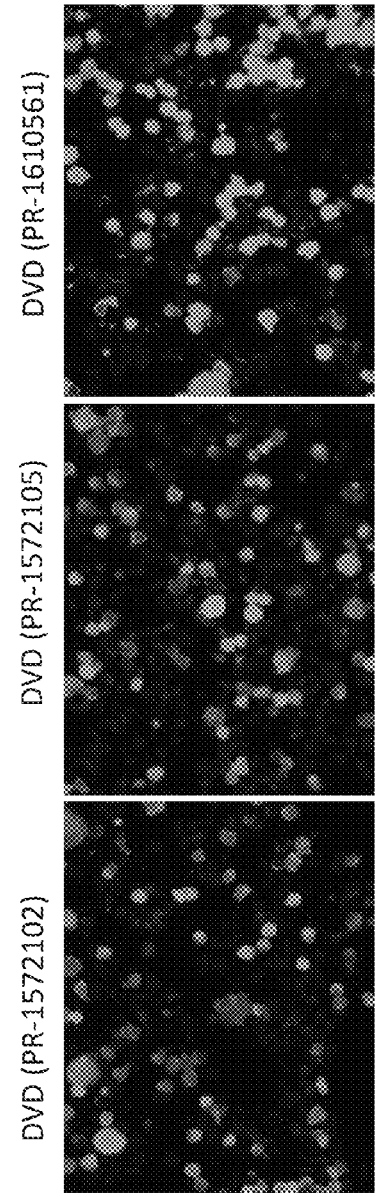
FIG. 2A
FIG. 2B

_US 9,840,554 B2_

ANTIBODIES AGAINST PLATELET-DERIVED GROWTH FACTOR (PDGF)

This application claims priority to U.S. Provisional Application Ser. No. 62/175,546, filed Jun. 15, 2015, and U.S. Provisional Application Ser. No. 62/291,964, filed Feb. 5, 2016, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Aug. 5, 2016, is named 12252_0202-00000_SL.txt and is 4,068,254 bytes in size.

FIELD

The invention relates to antibodies and antigen-binding fragments thereof, as well as multivalent and multispecific binding proteins, that bind vascular endothelial growth factor (VEGF) and/or platelet-derived growth factor (PDGF), as well as their receptors, and methods of making, and using the constructs in the diagnosis, prevention, and/or treatment of acute and chronic inflammatory diseases, cancer, and other disorders.

BACKGROUND

Angiogenesis, the formation of new blood vessels from pre-existing vasculature, plays a role in the pathogenesis of many diseases, including ocular diseases such as age-related macular degeneration (AMD) or diabetic macular edema (DME). Vascular endothelial growth factor (VEGF) plays a role in the regulation of normal and abnormal angiogenesis (Ferrara et al, (1997) Endoer. Rev. 18:4-25). Several anti-VEGF agents are provided in the art, e.g., in U.S. Pat. No. 7,169,901, which discloses VEGF antibodies for inhibiting VEGF-induced cell proliferation, and U.S. Pat. No. 7,070,959, which discloses isolated nucleic acid molecules encoding fusion proteins capable of binding VEGF.

Targeting VEGF with currently available therapeutics is not effective in all patients or for all diseases associated with inflammation and/or angiogenesis. A significant population of non-responders present following anti-VEGF monotherapy, and the disease prevalence will only increase as the aging population increases globally.

A currently preferred treatment for wet AMD consists of intravitreal injections of an anti-VEGF agent. However, although anti-VEGF therapy reduces choroidal neovascularization, it does not have an effect on regression of the mature vasculature. Also, current agents do not provide an anti-fibrotic effect, so that once scarring of the retina occurs; visual acuity cannot be recovered. Other limitations of the existing treatments regimens include patient discomfort, the need for repeat injections with inherent complications including endophthalmitis, retinal tear and detachment, intraocular hemorrhage, and cataract formation. There is a substantial time burden on ophthalmologists to provide monthly intravitreal treatment and optical coherence tomography (OCT) measurements on a large volume patients. As a result, there is a significant medical and economic need for an AMD therapeutic with greater efficacy, or that can be delivered less frequently and still achieve optimal efficacy.

Platelet-derived growth factor (PDGF) is a growth factor involved in the regulation of blood vessels from pre-existing vessel tissue. PDGF binds to receptors on pericytes in newly-forming abnormal blood vessels. This may contribute to neovascularization of abnormal blood vessels by providing a protective perictye coating, for example, during ocular disorders such as wet AMD.

Engineered proteins, such as antibodies, fragments, and multispecific binding proteins capable of binding two or more antigens, are known in the art. Such multispecific binding proteins can be generated using cell fusion, chemical conjugation, or recombinant DNA techniques. There are a variety of multispecific binding protein structures known in the art and many structures and methods have distinct disadvantages.

Bispecific antibodies have been produced using quadroma technology. Bispecific antibodies can also be produced by chemical conjugation of two different mAbs. Other approaches include coupling of two parental antibodies with a hetero-bifunctional crosslinker, production of tandem single-chain Fv molecules, diabodies, bispecific diabodies, single-chain diabodies, and di-diabodies. In addition, a multivalent antibody construct comprising two Fab repeats in the heavy chain of an IgG and capable of binding four antigen molecules has been described (see PCT Publication No. WO 01/77342 and Miller et al. (2003) J. Immunol. 170(9):4854-61).

U.S. Pat. No. 7,612,181 (incorporated herein by reference in its entirety) provides a novel family of binding proteins capable of binding two or more antigens with high affinity, which are called dual variable domain binding proteins (DVD-Ig binding protein) or dual variable domain immunoglobulins (DVD-Ig). DVD-Ig molecules are binding proteins that may be used to bind two distinct epitopes on the same molecule or two different molecules simultaneously. DVD-Ig molecules are unique binding proteins comprised of two variable domains fused to N-terminal constant regions. The variable domains may be directly fused to one another or connected via synthetic peptide linkers of assorted length and amino acid composition. DVD-Ig binding proteins may be engineered with intact and functional Fc domains, or otherwise modified constant domains, allowing them to mediate appropriate effector functions and exhibit other desired properties. The DVD-Ig format, due to its flexibility of choice of variable domain pair, orientation of two antigen-binding domains, and the length of the linker that joins them, may provide novel therapeutic modalities.

Accordingly, while VEGF monotherapy has had some success in the art, there remains a need for constructs exhibiting better targeting, efficiency, and/or efficacy in binding to VEGF, as well as improved targeting of other pathways involved in inflammation (such as ocular inflammation), e.g., the PDGF pathway. Improved targeting of either of these molecules, alone or in combination, may lead to improvements in, e.g., preventing, diagnosing, and/or treating disorders such as angiogenic, inflammatory, and/or ocular disorders. Also, while a variety of structures have been provided in the art, with various advantages and disadvantages, new variable domain sequences can further improve the properties of binding proteins targeting VEGF and/or PDGF, or their cognate receptors.

SUMMARY

Disclosed herein are binding proteins capable of binding VEGF and/or PDGF, and/or their cognate receptors. In some embodiments, the binding proteins are antibodies to VEGF and/or PDGF, or antigen-binding fragments thereof. In some embodiments, the binding proteins are bispecific and capable of binding VEGF and PDGF. In some embodiments, the binding proteins comprise one or more sequences from any one of Tables A, 27-30, 38-42, 46-50, or 56-58, or the CDR amino acid residues from those sequences.

In various embodiments, the binding proteins are bispecific or multispecific binding proteins capable of binding one or more of VEGF and/or PDGF, and/or their cognate receptors. In some embodiments, the binding proteins are dual variable domain immunoglobulins (DVD-Igs or DVD-Ig binding proteins) using the binding protein framework disclosed in U.S. Pat. No. 7,612,181 (incorporated herein by reference in its entirety).

In some embodiments, the DVD-Ig binding proteins contain particular first and second polypeptide chains, each comprising first and second variable domains comprising sequences (e.g., sequences selected from those listed in Tables A, 27-30, 38-42, 46-50, or 56-58, or the CDR amino acid residues from those sequences) that form functional binding sites for binding targets such as VEGF and/or PDGF, or their cognate receptors. In some embodiments, the first and second polypeptide chains of the binding protein each independently comprise VD1-(X1)n-VD2-C-X2, wherein VD1 is a first variable domain; VD2 is a second variable domain; C is a constant domain; X1 is a linker; X2 is an Fc region that is either present or absent; n is 0 or 1, and wherein the VD1 domains on the first and second polypeptide chains form a first functional target binding site for VEGF, PDGF, or a cognate receptor, and the VD2 domains on the first and second polypeptide chains form a second functional target binding site for VEGF, PDGF, or a cognate receptor. In some embodiments, (a) the first polypeptide chain of the binding protein comprises VD1-(X1)n-VD2-C-X2, wherein VD1 is a first heavy chain variable domain; VD2 is a second heavy chain variable domain; C is a heavy chain constant domain; X1 is a linker; X2 is an Fc region; and n is 0 or 1 (i.e., X1 and X2 are either present or absent, depending on whether n is independently chosen to be 0 or 1 for each position); and (b) the second polypeptide chain of the binding protein comprises VD1-(X1)n-VD2-C-X2, wherein VD1 is a first light chain variable domain; VD2 is a second light chain variable domain; C is a light chain constant domain; X1 is a linker; X2 is an Fc region; and n is 0 or 1 for X1 and n is 0 for X2 (i.e., the Fc region is absent on the second polypeptide chain); and (c) wherein the VD1 domains on the first and second polypeptide chains form a first functional target binding site for VEGF, PDGF, or a cognate receptor, and the VD2 domains on the first and second polypeptide chains form a second functional target binding site for VEGF, PDGF, or a cognate receptor. In some embodiments, the VD1 position forms a binding site for VEGF and the VD2 position forms a binding site for PDGF. In some embodiments, the CDR and/or variable domains at the VD1 and VD2 positions are antibody variable domains and the constant domains are antibody constant domains. Any of the CDR and/or variable domain and/or first and second polypeptide chain sequences disclosed herein may be incorporated in these DVD-Ig binding protein structures to form binding domains for VEGF and/or PDGF, and/or their cognate receptors.

In some embodiments, both the first and second binding sites of a DVD-Ig construct disclosed herein target VEGF. In some embodiments, both the first and second binding sites target PDGF. In some embodiments, the first binding site targets VEGF and the second binding site targets PDGF. In some embodiments, the first binding site targets PDGF and the second binding site targets VEGF. In some embodiments, an Fc domain is present on one polypeptide chain and absent on the other, or absent on both polypeptide chains. In some embodiments, the sequences of the first and second variable domains on each polypeptide chain (i.e., the VD1 and VD2 positions) are independently selected from the sequences in Table A, 27-30, 38-42, 46-50, or 56-58 to form functional binding sites. In some embodiments, the sequences of the first and second variable domains each contain the three complementarity determining regions (i.e., CDRs 1-3) from the selected sequences listed in Tables A, 27-30, 38-42, 46-50, or 56-58, and are arranged in the same order as shown in the Tables, thereby forming functional binding sites (i.e., the binding domains are capable of binding to their target antigen, VEGF or PDGF). In some embodiments, the paired variable domain sequences on the first and second polypeptide chains (i.e., the VD1 sequence on the first chain paired with the VD1 sequence on the second chain and the VD2 sequence on the first chain paired with the VD2 sequence on the second chain) form functional binding sites for binding targets VEGF and/or PDGF using the sequences in the Tables. In some embodiments, the binding proteins are capable of binding to VEGF and/or PDGF with improved binding affinity and/or neutralization potency, improved in vivo efficacy, improved expression, and/or improved drug-like properties (e.g., thermal stability, storage stability, solubility, etc.).

Also disclosed herein are methods of making and using the claimed binding proteins, e.g., in the detection, inhibition, reduction, prevention, and/or treatment of cancers, tumors, fibrosis, renal disease, inflammation, age-related macular degeneration (AMD), wet AMD, diabetic retinopathy, other angiogenesis-dependent diseases, or angiogenesis-independent diseases characterized by aberrant VEGF and/or PDGF expression or activity.

BRIEF DESCRIPTION OF THE DRAWINGS

FIG. 2A and FIG. 2B show the reactivity of anti-PDGF-BB antibodies and anti-VEGF-A/anti-PDGF-BB DVD-Ig molecules to ECM-associated PDGF-BB.

DETAILED DESCRIPTION

Figure 1A:
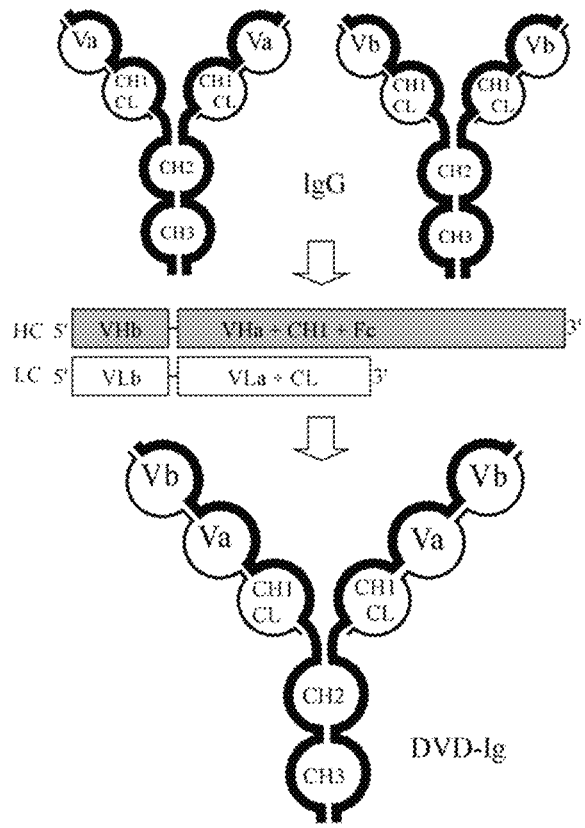
FIG. 1A and FIG. 1B are schematic representations of a Dual Variable Domain (DVD) binding protein construct.

Vascular endothelial growth factor (VEGF) is a signal protein that regulates physiological angiogenesis during embryogenesis, skeletal growth, and reproductive functions. Aberrant expression of VEGF is implicated in pathological angiogenesis and is associated with tumors, intraocular neovascular disorders, and other diseases. The VEGF family members include VEGF-A, placenta growth factor (PGF), VEGF-B, VEGF-C, and VEGF-D. Multiple isoforms of VEGF-A exist that result from alternative splicing of a single, 8-exon VEGFA gene. The biological effects of VEGF are mediated by various receptors, including two receptor tyrosine kinases, VEGF receptor-1 (VEGFR1) and VEGF receptor-2 (VEGFR2), which differ in their signaling properties. When cells are deficient in oxygen, they produce hypoxia-inducible factor (HIF) which releases VEGF and other mediators triggering a tyrosine kinase pathway leading to angiogenesis (Ferrara et al. (2003) Nat. Med. 9:669-676). In various embodiments, the binding proteins disclosed herein can bind one or more of the VEGF family members, including alternate isoforms, and/or can bind one or more of the cognate VEGF receptors.

Platelet-derived growth factor (PDGF) is a protein that stimulates growth, survival, and motility of mesenchymal cells and certain other cell types. It has significant functions during embryonal development and in the control of blood vessel formation as an adult. PDGF is composed of a dimeric glycoprotein made up of two A (-AA), two B (-BB) chains, or a combination of the two (-AB). There are five different isoforms of PDGF that moderate cellular responses through two receptors, alpha (PDGFRA) and beta (PDGFRB) (Heldin (2013) Cell Commun Sig. 11:97). PDGF plays an important role in driving the proliferation of undifferentiated mesenchyme and some progenitor populations. Overactivity or inappropriate PDGF signaling is associated with the development of certain malignant diseases, as well as non-malignant diseases characterized by excessive cell proliferation and other inflammatory disorders. In various embodiments, the binding proteins disclosed herein can bind one or more of the PDGF isoforms, and/or can bind one or more of the cognate PDGF receptors.

Binding Proteins

Disclosed herein are binding proteins capable of binding one or more of VEGF, PDGF, and their cognate receptors. In some embodiments, the binding protein is an antibody or an antigen-binding fragment thereof. In an embodiment, the binding protein is an antibody, a monoclonal antibody, a murine antibody, a human antibody, a humanized antibody, a bispecific antibody, a chimeric antibody, a Fab, a Fab', a F(ab')$_2$, an ScFv, an SMIP, an affibody, an avimer, a versabody, a nanobody, a fynomab, a domain antibody, or an antigen binding fragment of any of the foregoing. In an embodiment, the binding protein comprises antibody heavy chain variable domain sequences and antibody light chain variable domain sequences that are capable of binding one or more of VEGF, PDGF, and their cognate receptors. In an embodiment, the binding protein comprises the paired heavy and light chain variable domain sequences of any of the binding sites disclosed in Tables 27-30, 38-42, 46-50, or the CDR sequences from those variable domains. The CDR sequences of the variable domains in the Tables are identified in bold.

In some embodiments, the binding proteins disclosed herein is bispecific or multispecific. The bispecific or multispecific construct may be monovalent or bivalent. Various bispecific or multispecific constructs are known in the art (see e.g., Spiess et al. (2015) Mol. Immunol. 67; 95-106). Bispecific or multispecific constructs include, but are not limited to, an asymmetric bispecific antibody, an asymmetric bispecific IgG4, a CrossMab binding protein, a bispecific antibody, a bispecific binding protein, a multispecific binding protein, a DAF (dual action Fab antibody; two-in-one), a DAF (dual action Fab antibody; four-in-one), a DutaMab, a DT-IgG, a knobs-in-holes binding protein, a Charge pair binding protein, a Fab-arm exchange binding protein, a SEEDbody, a Triomab (Triomab quadroma bispecific or removab bispecific), a LUZ-Y, a Fcab, a κλ-body, an iMab (innovative multimer), and an Orthogonal Fab. In some embodiments, the bispecific or multispecific construct is a DVD-Ig binding protein, an IgG(H)-scFv, an scFv-(H)IgG, an IgG(L)-scFv, an scFv-(L)IgG, an IgG(L, H)-Fv, an IgG (H)-V, a V(H)-IgG, an IgG(L)-V, a V(L)-IgG, a KIH IgG-scFab, a 2scFv-IgG, an IgG-2scFv, an scFv4-Ig, a Zybody, or a DVI-IgG (four-in-one). In some embodiments, the bispecific or multispecific construct also can be a nanobody (or VHH), a bispecific tandem nanobody, a bispecific trivalent tandem nanobody, a nanobody-HSA, a BiTE (bispecific T-cell engager) binding protein, a Diabody, a DART (dual affinity retargeting) binding protein, a TandAb (tetravalent bispecifc tandem antibody), an scDiabody, an scDiabody-CH3, a Diabody-CH3, a Triple Body, a Miniantibody, a Minibody, a TriBi minibody, an scFv-CH3 KIH, a Fab-scFv, an scFv-CH-CL-scFv, a F(ab')2, a F(ab')2 scFv2, an scFv-KIH, a Fab-scFv-Fc, a Tetravalent HCAb, an scDiabody-Fc, a Diabody-Fc, a Tandem scFv-Fc, a Fabsc, a bsFc-1/2, a CODV-Ig (cross-over dual variable immunoglobulin), a biclonics antibody or an Intrabody. Bispecific or multispecific constructs also include, for example, a Dock and Lock binding protein, an ImmTAC, an HSAbody, an scDiabody-HSA, a Tandem scFv-Toxin, an IgG-IgG binding protein, a Cov-X-Body, and an scFv1-PEG-scFv2. In some embodiments, the bispecific or multispecific construct is a DVD-Ig binding protein, a CrossMab binding protein, a diabody, a tandem single-chain Fv molecule, a bispecific diabody, a single-chain diabody molecule, or a di-diabody. In some embodiments, the binding protein is a DVD-Ig binding protein. See, e.g., U.S. Pat. No. 7,612,181 (incorporated herein by reference in its entirety). The bispecific or multispecific construct may comprise one or more binding sites for VEGF, PDGF, and/or their receptors. The bispecific or multispecific construct may comprise binding sites only for VEGF, PDGF, and/or their receptors, or may comprise additional binding sites for other antigen targets. The bispecific or multispecific construct may comprise binding sites for more than one epitope on VEGF, PDGF, and/or their receptors, e.g., using different CDR sets or variable domains from those disclosed herein to form binding sites targeting different epitopes.

In various embodiments, the binding protein is capable of binding VEGF, and comprises CDRs 1-3 from SEQ ID NO: 17 and CDRs 1-3 from SEQ ID NO: 18, CDRs 1-3 from SEQ ID NO: 19 and CDRs 1-3 from SEQ ID NO: 20, CDRs 1-3 from SEQ ID NO: 21 and CDRs 1-3 from SEQ ID NO: 22, CDRs 1-3 from SEQ ID NO: 23 and CDRs 1-3 from SEQ ID NO: 24, CDRs 1-3 from SEQ ID NO: 25 and CDRs 1-3 from SEQ ID NO: 26, CDRs 1-3 from SEQ ID NO: 27 and CDRs 1-3 from SEQ ID NO: 28, CDRs 1-3 from SEQ ID NO: 29 and CDRs 1-3 from SEQ ID NO: 30, CDRs 1-3 from SEQ ID NO: 31 and CDRs 1-3 from SEQ ID NO: 32, CDRs 1-3 from SEQ ID NO: 33 and CDRs 1-3 from SEQ ID NO: 34, CDRs 1-3 from SEQ ID NO: 35 and CDRs 1-3 from SEQ ID NO: 36, CDRs 1-3 from SEQ ID NO: 37 and CDRs 1-3 from SEQ ID NO: 38, CDRs 1-3 from SEQ ID NO: 39 and CDRs 1-3 from SEQ ID NO: 40, CDRs 1-3 from SEQ ID NO: 41 and CDRs 1-3 from SEQ ID NO: 42, or CDRs 1-3 from SEQ ID NO: 43 and CDRs 1-3 from SEQ ID NO: 44. In an embodiment, the binding protein is capable of binding VEGF, and comprises SEQ ID NO: 17 and SEQ ID NO: 18, SEQ ID NO: 19 and SEQ ID NO: 20, SEQ ID NO: 21 and SEQ ID NO: 22, SEQ ID NO: 23 and SEQ ID NO: 24, SEQ ID NO: 25 and SEQ ID NO: 26, SEQ ID NO: 27 and SEQ ID NO: 28, SEQ ID NO: 29 and SEQ ID NO: 30, SEQ ID NO: 31 and SEQ ID NO: 32, SEQ ID NO: 33 and SEQ ID NO: 34, SEQ ID NO: 35 and SEQ ID NO: 36, SEQ ID NO: 37 and SEQ ID NO: 38, SEQ ID NO: 39 and SEQ ID NO: 40, SEQ ID NO: 41 and SEQ ID NO: 42, or SEQ ID NO: 43 and SEQ ID NO: 44. Any of said binding proteins capable of binding VEGF may also be capable of binding PDGF, and may comprise any of the PDGF binding sequences as described herein.

In various embodiments, the binding protein is capable of binding PDGF, and comprises CDRs 1-3 from SEQ ID NO: 1 and CDRs 1-3 from SEQ ID NO: 2, CDRs 1-3 from SEQ ID NO: 3 and CDRs 1-3 from SEQ ID NO: 4, CDRs 1-3 from SEQ ID NO: 5 and CDRs 1-3 from SEQ ID NO: 6, CDRs 1-3 from SEQ ID NO: 7 and CDRs 1-3 from SEQ ID NO: 8, CDRs 1-3 from SEQ ID NO: 9 and CDRs 1-3 from SEQ ID NO: 10, CDRs 1-3 from SEQ ID NO: 11 and CDRs 1-3 from SEQ ID NO: 12, CDRs 1-3 from SEQ ID NO: 13 and CDRs 1-3 from SEQ ID NO: 14, CDRs 1-3 from SEQ ID NO: 15 and CDRs 1-3 from SEQ ID NO: 16, or CDRs 1-3 from SEQ ID NO: 211 and CDRs 1-3 from SEQ ID NO: 212. In an embodiment, the binding protein is capable of binding PDGF, and comprises SEQ ID NO: 1 and SEQ ID NO: 2, SEQ ID NO: 3 and SEQ ID NO: 4, SEQ ID NO: 5 and SEQ ID NO: 6, SEQ ID NO: 7 and SEQ ID NO: 8, SEQ ID NO: 9 and SEQ ID NO: 10, SEQ ID NO: 11 and SEQ ID NO: 12, SEQ ID NO: 13 and SEQ ID NO: 14, SEQ ID NO: 15 and SEQ ID NO: 16, or SEQ ID NO: 211 and SEQ ID NO: 212. Any of said binding proteins capable of binding PDGF may also be capable of binding VEGF, and may comprise any of the VEGF binding sequences as described herein.

In an embodiment, the binding protein is a bispecific or multispecific antibody capable of binding one or more of VEGF, PDGF, and their cognate receptors, or another multispecific construct capable of binding the targets. In certain embodiments, the treatment is with bispecific antibodies that have been produced by quadroma technology (Milstein and Cuello (1983) Nature 305(5934): 537-40), by chemical conjugation of two different monoclonal antibodies (Staerz et al. (1985) Nature 314(6012): 628-31), or by knob-into-hole or similar approaches which introduces mutations in the Fc region (Holliger et al. (1993) Proc. Natl. Acad. Sci. USA 90(14): 6444-6448). In some embodiments, the multispecific binding protein is a dual variable domain immunoglobulin (DVD-Ig), e.g., as disclosed in U.S. Pat. No. 7,612,181 (incorporated herein by reference in their entirety). In an embodiment, the DVD-Ig binding protein comprises one or more binding sites comprising the paired heavy and light chain variable domain sequences of any of the binding sites disclosed in Tables 27-30, 38-42, 46-50, or 56-58, or the CDR sequences from those variable domains. For instance, a binding site for VEGF can comprise a paired set of heavy and light chain variable domain sequences from any one of Tables 27 or 38-42, or the CDR regions from those sequences, while the PDGF can comprise the paired heavy and light chain variable domain sequences in Tables 28 or 46-50, or the CDR regions from those sequences. The CDR regions of some of these sequences are shown in Table A and in Table 57.

In some embodiments, a multispecific binding protein disclosed herein is capable of binding VEGF and PDGF, and allows for fewer injections or a lower concentration of active agent, as compared to combination antibody therapy.

In some embodiments, the DVD-Ig binding protein comprises first and second polypeptide chains, each independently comprising VD1-(X1)n-VD2-C-X2, wherein: VD1 is a first variable domain; VD2 is a second variable domain; C is a constant domain; X1 is a linker; X2 is an Fc region that is either present or absent; n is independently 0 or 1 on the first and second chains, and wherein the VD1 domains on the first and second polypeptide chains form a first functional target binding site and the VD2 domains on the first and second polypeptide chains form a second functional target binding site. In some embodiments, the binding protein is capable of binding one or more of VEGF, PDGF, and their cognate receptors, e.g., using a paired set of sequences from any one of Tables 27-30, 38-42, 46-50, or 56-58. In some embodiments, the binding protein comprises VD1 sequences on the first and second polypeptide chains (i.e., a VD1 sequence on the first chain paired with a VD1 sequence on the second chain) that together form a binding domain capable of binding a target selected from VEGF, PDGF, and their cognate receptors. In some embodiments, the binding protein is capable of binding VEGF at both the VD1 and VD2 positions. In some embodiments, the binding protein is capable of binding PDGF at both the VD1 and VD2 positions. In some embodiments, the binding protein is capable of binding VEGF at the VD1 position and PDGF at the VD2 position. In some embodiments, the binding protein is capable of binding PDGF at the VD1 position and VEGF at the VD2 position.

When a binding protein comprises the CDRs from a sequence selected from any one of Tables 27-30, 38-42, 46-50, or 56-58, the CDRs are arranged in the order specified by the sequence in the Table and separated by suitable framework sequences to form a functional binding site. The paired sequences selected from the Tables that form a functional binding site for a target (e.g., a binding site for VEGF and/or PDGF), or the CDRs from those sequences, may be placed in either the VD1 or VD2 positions on the first and second polypeptide chains to form a binding site at either the VD1 or VD2 domain.

The binding proteins disclosed herein comprise VD1 and VD2 binding domains that are capable of binding to first and second target antigens. As used herein, a VD1 domain or a VD2 domain, or a VD1 position or VD2 position, may refer to either the variable domain sequence on one polypeptide chain (e.g., a VD1 heavy chain sequence) or to the variable domain sequences on both the first and second polypeptide chain (e.g., a VD1 heavy chain sequence and a VD1 light chain sequence) that together form the functional binding site, as indicated by the context in which it is discussed.

Figure 1B:
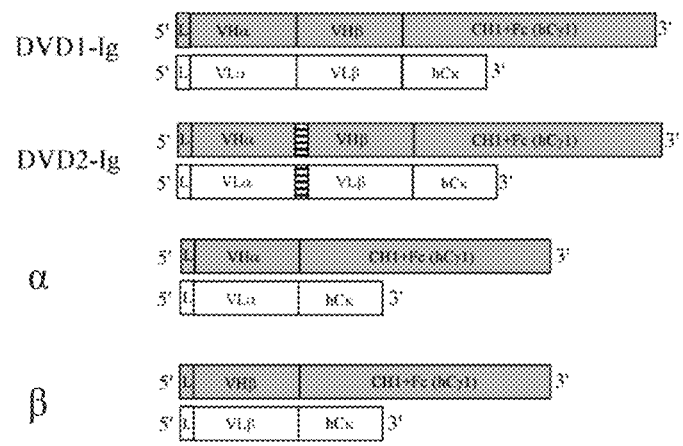

In some embodiments, a DVD-Ig binding protein can comprise two first and two second polypeptide chains forming four functional binding sites on two arms of the construct. An example of a four chain structure having two arms, each arm comprising a first and second polypeptide chain and two functional binding sites, is shown in FIG. 1.

In an embodiment, the DVD-Ig binding protein is capable of binding VEGF and PDGF, wherein the binding site for VEGF comprises CDRs 1-3 from SEQ ID NO: 17 and CDRs 1-3 from SEQ ID NO: 18, CDRs 1-3 from SEQ ID NO: 19 and CDRs 1-3 from SEQ ID NO: 20, CDRs 1-3 from SEQ ID NO: 21 and CDRs 1-3 from SEQ ID NO: 22, CDRs 1-3 from SEQ ID NO: 23 and CDRs 1-3 from SEQ ID NO: 24, CDRs 1-3 from SEQ ID NO: 25 and CDRs 1-3 from SEQ ID NO: 26, CDRs 1-3 from SEQ ID NO: 27 and CDRs 1-3 from SEQ ID NO: 28, CDRs 1-3 from SEQ ID NO: 29 and CDRs 1-3 from SEQ ID NO: 30, CDRs 1-3 from SEQ ID NO: 31 and CDRs 1-3 from SEQ ID NO: 32, CDRs 1-3 from SEQ ID NO: 33 and CDRs 1-3 from SEQ ID NO: 34, CDRs 1-3 from SEQ ID NO: 35 and CDRs 1-3 from SEQ ID NO: 36, CDRs 1-3 from SEQ ID NO: 37 and CDRs 1-3 from SEQ ID NO: 38, CDRs 1-3 from SEQ ID NO: 39 and CDRs 1-3 from SEQ ID NO: 40, CDRs 1-3 from SEQ ID NO: 41 and CDRs 1-3 from SEQ ID NO: 42, or CDRs 1-3 from SEQ ID NO: 43 and CDRs 1-3 from SEQ ID NO: 44. In an embodiment, the binding site for VEGF comprises SEQ ID NO: 17 and SEQ ID NO: 18, SEQ ID NO: 19 and SEQ ID NO: 20, SEQ ID NO: 21 and SEQ ID NO: 22, SEQ ID NO: 23 and SEQ ID NO: 24, SEQ ID NO: 25 and SEQ ID NO: 26, SEQ ID NO: 27 and SEQ ID NO: 28, SEQ ID NO: 29 and SEQ ID NO: 30, SEQ ID NO: 31 and SEQ ID NO: 32, SEQ ID NO: 33 and SEQ ID NO: 34, SEQ ID NO: 35 and SEQ ID NO: 36, SEQ ID NO: 37 and SEQ ID NO: 38, SEQ ID NO: 39 and SEQ ID NO: 40, SEQ ID NO: 41 and SEQ ID NO: 42, or SEQ ID NO: 43 and SEQ ID NO: 44.

In an embodiment, a DVD-Ig binding protein is disclosed that is capable of binding VEGF and PDGF, wherein the binding site for PDGF comprises CDRs 1-3 from SEQ ID NO: 1 and CDRs 1-3 from SEQ ID NO: 2, CDRs 1-3 from SEQ ID NO: 3 and CDRs 1-3 from SEQ ID NO: 4, CDRs 1-3 from SEQ ID NO: 5 and CDRs 1-3 from SEQ ID NO: 6, CDRs 1-3 from SEQ ID NO: 7 and CDRs 1-3 from SEQ ID NO: 8, CDRs 1-3 from SEQ ID NO: 9 and CDRs 1-3 from SEQ ID NO: 10, CDRs 1-3 from SEQ ID NO: 11 and CDRs 1-3 from SEQ ID NO: 12, CDRs 1-3 from SEQ ID NO: 13 and CDRs 1-3 from SEQ ID NO: 14, CDRs 1-3 from SEQ ID NO: 15 and CDRs 1-3 from SEQ ID NO: 16, or CDRs 1-3 from SEQ ID NO: 211 and CDRs 1-3 from SEQ ID NO: 212. In an embodiment, the binding site for PDGF comprises SEQ ID NO: 1 and SEQ ID NO: 2, SEQ ID NO: 3 and SEQ ID NO: 4, SEQ ID NO: 5 and SEQ ID NO: 6, SEQ ID NO: 7 and SEQ ID NO: 8, SEQ ID NO: 9 and SEQ ID NO: 10, SEQ ID NO: 11 and SEQ ID NO: 12, SEQ ID NO: 13 and SEQ ID NO: 14, SEQ ID NO: 15 and SEQ ID NO: 16, or SEQ ID NO: 211 and SEQ ID NO: 212.

In an embodiment, the DVD-Ig binding protein is capable of binding VEGF and PDGF, wherein the binding site for VEGF comprises CDRs 1-3 from SEQ ID NO: 17 and CDRs 1-3 from SEQ ID NO: 18, CDRs 1-3 from SEQ ID NO: 19 and CDRs 1-3 from SEQ ID NO: 20, CDRs 1-3 from SEQ ID NO: 21 and CDRs 1-3 from SEQ ID NO: 22, CDRs 1-3 from SEQ ID NO: 23 and CDRs 1-3 from SEQ ID NO: 24, CDRs 1-3 from SEQ ID NO: 25 and CDRs 1-3 from SEQ ID NO: 26, CDRs 1-3 from SEQ ID NO: 27 and CDRs 1-3 from SEQ ID NO: 28, CDRs 1-3 from SEQ ID NO: 29 and CDRs 1-3 from SEQ ID NO: 30, CDRs 1-3 from SEQ ID NO: 31 and CDRs 1-3 from SEQ ID NO: 32, CDRs 1-3 from SEQ ID NO: 33 and CDRs 1-3 from SEQ ID NO: 34, CDRs 1-3 from SEQ ID NO: 35 and CDRs 1-3 from SEQ ID NO: 36, CDRs 1-3 from SEQ ID NO: 37 and CDRs 1-3 from SEQ ID NO: 38, CDRs 1-3 from SEQ ID NO: 39 and CDRs 1-3 from SEQ ID NO: 40, CDRs 1-3 from SEQ ID NO: 41 and CDRs 1-3 from SEQ ID NO: 42, or CDRs 1-3 from SEQ ID NO: 43 and CDRs 1-3 from SEQ ID NO: 44; and the binding site for PDGF comprises CDRs 1-3 from SEQ ID NO: 1 and CDRs 1-3 from SEQ ID NO: 2, CDRs 1-3 from SEQ ID NO: 3 and CDRs 1-3 from SEQ ID NO: 4, CDRs 1-3 from SEQ ID NO: 5 and CDRs 1-3 from SEQ ID NO: 6, CDRs 1-3 from SEQ ID NO: 7 and CDRs 1-3 from SEQ ID NO: 8, CDRs 1-3 from SEQ ID NO: 9 and CDRs 1-3 from SEQ ID NO: 10, CDRs 1-3 from SEQ ID NO: 11 and CDRs 1-3 from SEQ ID NO: 12, CDRs 1-3 from SEQ ID NO: 13 and CDRs 1-3 from SEQ ID NO: 14, CDRs 1-3 from SEQ ID NO: 15 and CDRs 1-3 from SEQ ID NO: 16, or CDRs 1-3 from SEQ ID NO: 211 and CDRs 1-3 from SEQ ID NO: 212. In an embodiment, the binding site for VEGF comprises SEQ ID NO: 17 and SEQ ID NO: 18, SEQ ID NO: 19 and SEQ ID NO: 20, SEQ ID NO: 21 and SEQ ID NO: 22, SEQ ID NO: 23 and SEQ ID NO: 24, SEQ ID NO: 25 and SEQ ID NO: 26, SEQ ID NO: 27 and SEQ ID NO: 28, SEQ ID NO: 29 and SEQ ID NO: 30, SEQ ID NO: 31 and SEQ ID NO: 32, SEQ ID NO: 33 and SEQ ID NO: 34, SEQ ID NO: 35 and SEQ ID NO: 36, SEQ ID NO: 37 and SEQ ID NO: 38, SEQ ID NO: 39 and SEQ ID NO: 40, SEQ ID NO: 41 and SEQ ID NO: 42, or SEQ ID NO: 43 and SEQ ID NO: 44; and the binding site for PDGF comprises SEQ ID NO: 1 and SEQ ID NO: 2, SEQ ID NO: 3 and SEQ ID NO: 4, SEQ ID NO: 5 and SEQ ID NO: 6, SEQ ID NO: 7 and SEQ ID NO: 8, SEQ ID NO: 9 and SEQ ID NO: 10, SEQ ID NO: 11 and SEQ ID NO: 12, SEQ ID NO: 13 and SEQ ID NO: 14, SEQ ID NO: 15 and SEQ ID NO: 16, or SEQ ID NO: 211 and SEQ ID NO: 212.

In various embodiments, the DVD-Ig binding protein is capable of binding VEGF and PDGF, wherein the binding site for VEGF comprises CDRs 1-3 from SEQ ID NO: 35 and CDRs-1-3 from SEQ ID NO: 36, and the binding site for PDGF comprises CDRs 1-3 from SEQ ID NO: 15 and CDRs-1-3 from SEQ ID NO: 16. In an embodiment, the binding site for VEGF comprises SEQ ID NO: 35 and SEQ ID NO: 36, and the binding site for PDGF comprises SEQ ID NO: 15 and SEQ ID NO: 16. In any of these embodiments, the binding site for VEGF may be the outer binding domain or VD1 position as described herein, and the binding site for PDGF may be the inner domain or VD2 position as described herein. In various embodiments, any of the DVD-Ig binding proteins disclosed herein can comprise one or more of the X1 linkers shown in Table 55. In an embodiment, the X1 linker on the heavy chain is a GS-H10 linker and the X1 linker on the light chain is a GS-L10(dR) linker. In an embodiment, the X1 linker on the heavy chain is a GS-H10 linker and the X1 linker on the light chain is a GS-L10 linker. In an embodiment, the X1 linker on the heavy chain is an HG-short linker and the X1 linker on the light chain is an LK-long linker.

In various embodiments, any of the antibodies, binding proteins, or DVD-Ig binding proteins disclosed herein can comprise a human IgG (e.g., an IgG1) heavy chain constant region on the first polypeptide chain comprising substitutions of leucines at positions 234 and 235 with alanines, and optionally also (or alternatively) a substitution of histidine at position 435 with alanine, wherein the amino acid positions are numbered using EU index numbering. In various embodiments, the antibody, binding protein, or DVD-Ig binding protein can also comprise a human kappa or lambda light chain constant region on the second polypeptide chain. In an embodiment, the light chain comprises a wild-type human kappa light chain constant region sequence.

In an embodiment, the DVD-Ig binding protein is capable of binding VEGF and PDGF, and comprises PR-1610561 (comprising SEQ ID NOs: 131 and 132). In an embodiment, the binding protein comprises a heavy chain constant region on the first polypeptide chain comprising a human IgG1 heavy chain sequence modified by one or more amino acid changes, wherein the changes comprise substitution of leucines at positions 234 and 235 with alanines, and optionally also comprising a substitution of histidine at position 435 with alanine, wherein the amino acid positions are numbered using EU index numbering; and a light chain constant region on the second polypeptide chain comprising a human kappa light chain constant region sequence. In an embodiment, the binding protein comprises an IgG1 constant region with substitution of leucines at positions 234 and 235 with alanines, and a substitution of histidine at position 435 with alanine, wherein the amino acid positions are numbered using EU index numbering; and a light chain constant region on the second polypeptide chain comprising a human kappa light chain constant region sequence. In some embodiments, the L234A, L235A, and H435 mutations are present in a DVD-Ig binding protein comprising PR-1610561 (comprising SEQ ID NOs: 131 and 132). In some embodiments, the binding protein carrying the constant region mutations has increased ocular duration over an antibody, but is rapidly cleared from systemic circulation (e.g., by altering FcRn recognition), as compared to an antibody or as compared to the same binding protein lacking the constant region mutations. In some embodiments, the high ocular duration allows for less frequent administration and/or fewer overall injections while achieving a comparable or improved efficacy as compared to administration of a combination of anti-VEGF and anti-PDGF antibodies or as compared to administration of the binding protein lacking the constant region mutations. In some embodiments, the binding protein carrying the constant region mutations has decreased ADCC and CDC effector functions mediated by binding to extracellular matrix-associated VEGF-A and/or PDGF-BB, as compared to administration of the binding protein lacking the constant region mutations. In some embodiments, the binding protein carrying the constant region mutations does not bind to one or more Fc-gamma receptors. In some embodiments, systemic levels of the binding protein in a patient drops below detectable levels after less than 20, 25, 30, 35, or 40 hours following administration at 1, 2, 3, 4, 5, 6, 7, 8, 9, 10 mg/kg, or more (or any concentration in between) in an intravenous bolus dose.

In an embodiment, the DVD-Ig binding protein is capable of binding VEGF and PDGF, wherein the binding site for VEGF comprises CDRs 1-3 from SEQ ID NO: 17 and CDRs-1-3 from SEQ ID NO: 18, and the binding site for PDGF comprises CDRs 1-3 from SEQ ID NO: 1 and CDRs-1-3 from SEQ ID NO: 2. In an embodiment, the binding site for VEGF comprises SEQ ID NO: 17 and SEQ ID NO: 18, and the binding site for PDGF comprises SEQ ID NO: 1 and SEQ ID NO: 2. In an embodiment, the DVD-Ig binding protein is capable of binding VEGF and PDGF, wherein the binding site for VEGF comprises CDRs 1-3 from SEQ ID NO: 39 and CDRs-1-3 from SEQ ID NO: 40, and the binding site for PDGF comprises CDRs 1-3 from SEQ ID NO: 15 and CDRs-1-3 from SEQ ID NO: 16. In an embodiment, the binding site for VEGF comprises SEQ ID NO: 39 and SEQ ID NO: 40, and the binding site for PDGF comprises SEQ ID NO: 15 and SEQ ID NO: 16. In any of these embodiments, the binding site for VEGF may be the outer binding domain or VD1 sequence as described herein, and the binding site for PDGF may be the inner domain or VD2 sequence as described herein. In various embodiments, the binding proteins can comprise one or more of the X1 linkers shown in Table 55. In an embodiment, the X1 linker on the heavy chain is a GS-H10 linker and the X1 linker on the light chain is a GS-L10(dR) linker. In an embodiment, the X1 linker on the heavy chain is a GS-H10 linker and the X1 linker on the light chain is a GS-L10 linker. In an embodiment, the X1 linker on the heavy chain is an HG-short linker and the X1 linker on the light chain is an LK-long linker. In an embodiment, the binding protein is capable of binding VEGF and PDGF, and comprises PR-1572102 (comprising SEQ ID NOs: 88 and 89) or PR-1572105 (comprising SEQ ID NOs: 94 and 95) or PR1611292 (comprising SEQ ID NOs: 141 and 142). In an embodiment, the binding protein comprises a heavy chain constant region on the first polypeptide chain comprising a human IgG1 heavy chain sequence modified by one or more amino acid changes, wherein the changes comprise substitution of leucines at positions 234 and 235 with alanines, and optionally also comprising a substitution of histidine at position 435 with alanine, wherein the amino acid positions are numbered using EU index numbering; and a light chain constant region on the second polypeptide chain comprising a human kappa light chain constant region sequence.

In an embodiment, the DVD-Ig binding protein comprises the first and second polypeptide chains of any of the DVD-Ig binding proteins disclosed in Tables 56-58. The CDR sequences of the variable domains in Tables 56-58 are in bold and the linker sequences are italicized.

In an embodiment, the DVD-Ig binding protein comprises the first and second polypeptide chains of PR-1563988 (comprising SEQ ID NOs: 45 and 46), PR-1563990 (comprising SEQ ID NOs: 47 and 48), PR-1563998 (comprising SEQ ID NOs: 49 and 50), PR-1564009 (comprising SEQ ID NOs: 51 and 52), PR-1564010 (comprising SEQ ID NOs: 53 and 54), PR-1564011 (comprising SEQ ID NOs: 55 and 56), PR-1564012 (comprising SEQ ID NOs: 57 and 58), PR-1564013 (comprising SEQ ID NOs: 59 and 60), PR-1565031 (comprising SEQ ID NOs: 76 and 77), PR-1565032 (comprising SEQ ID NOs: 78 and 79), PR-1565035 (comprising SEQ ID NOs: 80 and 81), PR-1572102 (comprising SEQ ID NOs: 88 and 89), PR-1572103 (comprising SEQ ID NOs: 90 and 91), PR-1572104 (comprising SEQ ID NOs: 92 and 93), PR-1572105 (comprising SEQ ID NOs: 94 and 95), PR-1572106 (comprising SEQ ID NOs: 96 and 97), PR-1575832 (comprising SEQ ID NOs: 99 and 100), PR-1575834 (comprising SEQ ID NOs: 101 and 102), PR-1575835 (comprising SEQ ID NOs: 103 and 104), PR-1577165 (comprising SEQ ID NOs: 105 and 106), PR-1577166 (comprising SEQ ID NOs: 107 and 108), PR-1577547 (comprising SEQ ID NOs: 109 and 110), PR-1577548 (comprising SEQ ID NOs: 111 and 112), PR-1577550 (comprising SEQ ID NOs: 113 and 114), PR-1578137 (comprising SEQ ID NOs: 116 and 117), PR-1610560 (comprising SEQ ID NOs: 129 and 130), PR-1610561 (comprising SEQ ID NOs: 131 and 132), PR-1610562 (comprising SEQ ID NOs: 133 and 134), PR-1610563 (comprising SEQ ID NOs: 135 and 136), PR-1611291 (comprising SEQ ID NOs: 139 and 140), PR-1611292 (comprising SEQ ID NOs: 141 and 142), PR-1612489 (comprising SEQ ID NOs: 161 and 162), PR-1612491 (comprising SEQ ID NOs: 163 and 164), PR-1612492 (comprising SEQ ID NOs: 165 and 166), PR-1612495 (comprising SEQ ID NOs: 171 and 172), PR-1612496 (comprising SEQ ID NOs: 173 and 174), PR-1612499 (comprising SEQ ID NOs: 177 and 178), PR-1612500 (comprising SEQ ID NOs: 179 and 180), PR-1612501 (comprising SEQ ID NOs: 181 and 182), PR-1612502 (comprising SEQ ID NOs: 183 and 184), PR-1613183 (comprising SEQ ID NOs: 185 and 186), PR-1613184 (comprising SEQ ID NOs: 187 and 188), PR-1613185 (comprising SEQ ID NOs: 189 and 190), PR-1613190 (comprising SEQ ID NOs: 199 and 200), PR-1565040 (comprising SEQ ID NOs: 3844 and 3845), PR-1565042 (comprising SEQ ID NOs: 3837 and 3838), PR-1565044 (comprising SEQ ID NOs: 213 and 214), PR-1565051 (comprising SEQ ID NOs: 215 and 216), PR-1565083 (comprising SEQ ID NOs: 217 and 218), PR-1565084 (comprising SEQ ID NOs: 219 and 220), PR-1565085 (comprising SEQ ID NOs: 221 and 222), PR-1565086 (comprising SEQ ID NOs: 223 and 224), PR-1571821 (comprising SEQ ID NOs: 225 and 226), PR-1571823 (comprising SEQ ID NOs: 227 and 228), PR-1575521 (comprising SEQ ID NOs: 229 and 230), PR-1571824 (comprising SEQ ID NOs: 231 and 232), PR-1571825 (comprising SEQ ID NOs: 233 and 234), PR-1571826 (comprising SEQ ID NOs: 235 and 236), PR-1571827 (comprising SEQ ID NOs: 237 and 238), PR-1571828 (comprising SEQ ID NOs: 239 and 240), PR-1571830 (comprising SEQ ID NOs: 241 and 242), PR-1571831 (comprising SEQ ID NOs: 243 and 244), PR-1571832 (comprising SEQ ID NOs: 245 and 246), PR-1571836 (comprising SEQ ID NOs: 247 and 248), PR-1577053 (comprising SEQ ID NOs: 249 and 250), or PR-1577056 (comprising SEQ ID NOs: 251 and 252.

In some embodiments, a binding protein, including a DVD-Ig binding protein, antibody, or fragment thereof, is capable of binding VEGF and/or PDGF and has at least about 80%, 90%, 95%, or 99% homology to CDRs 1-3 or to the full variable domains of any of the sequences in Tables 27, 28, 38-42, or 46-50. As used herein, the term percent (%) homology defines the percentage of residues in the amino acid sequence variant that are identical after aligning the sequences and introducing gaps and other spacing, e.g., using the BLAST alignment software.

In an embodiment, the binding protein has an on rate constant ($K_{on}$) to one or more targets of at least about $10^2 M^{-1} s^{-1}$; at least about $10^3 M^{-1} s^{-1}$; at least about $10^4 M^{-1} s^{-1}$; at least about $10^5 M^{-1} s^{-1}$; or at least about $10^6 M^{-1} s^{-1}$, as measured by surface plasmon resonance. In an embodiment, the binding protein has an on rate constant ($K_{on}$) to one or more targets from about $10^2 M^{-1} s^{-1}$ to about $10^3 M^{-1} s^{-1}$; from about $10^3 M^{-1} s^{-1}$ to about $10^4 M^{-1} s^{-1}$; from about $10^4 M^{-1} s^{-1}$ to about $10^5 M^{-1} s^{-1}$; or from about $10^5 M^{-1} s^{-1}$ to about $10^6 M^{-1} s^{-1}$, as measured by surface plasmon resonance.

In an embodiment, the binding protein has an off rate constant ($K_{off}$) for one or more targets of at most about $10^{-3} s^{-1}$; at most about $10^{-4} s^{-1}$; at most about $10^{-5} s^{-1}$; or at most about $10^{-6} s^{-1}$, as measured by surface plasmon resonance. In an embodiment, the binding protein has an off rate constant ($K_{off}$) to one or more targets of about $10^{-3} s^{-1}$ to about $10^{-4} s^{-1}$; of about $10^{-4} s^{-1}$ to about $10^{-5} s^{-1}$; or of about $10^{-5} s^{-1}$ to about $10^{-6} s^{-1}$, as measured by surface plasmon resonance.

In an embodiment, the binding protein has a dissociation constant ($K_d$) to one or more targets of at most about $10^{-7} M$; at most about $10^{-8} M$; at most about $10^{-9} M$; at most about $10^{-10} M$; at most about $10^{-11} M$; at most about $10^{-12} M$; or at most $10^{-13} M$. In an embodiment, the binding protein has a dissociation constant ($K_d$) to its targets of about $10^{-7} M$ to about $10^{-8} M$; of about $10^{-8} M$ to about $10^{-9} M$; of about $10^{-9} M$ to about $10^{-10} M$; of about $10^{-10} M$ to about $10^{-11} M$; of about $10^{-11} M$ to about $10^{-12} M$; or of about $10^{-12}$ to M about $10^{-13} M$.

In an embodiment, the binding protein is a conjugate further comprising an agent. In an embodiment, the agent is an immunoadhesion molecule, an imaging agent, a therapeutic agent, or a cytotoxic agent. In an embodiment, the imaging agent is a radiolabel, an enzyme, a fluorescent label, a luminescent label, a bioluminescent label, a magnetic label, or biotin. In another embodiment, the radiolabel is $^3H$, $^{14}C$, $^{35}S$, $^{90}Y$, $^{99}Tc$, $^{111}In$, $^{125}I$, $^{131}I$, $^{177}Lu$, $^{166}Ho$, or $^{153}Sm$. In yet another embodiment, the therapeutic or cytotoxic agent is an anti-metabolite, an alkylating agent, an antibiotic, a growth factor, a cytokine, an anti-angiogenic agent, an anti-mitotic agent, an anthracycline, toxin, or an apoptotic agent, or an immunosuppressive agent.

In an embodiment, the binding protein is a crystallized binding protein and exists as a crystal. In an embodiment, the crystal is a carrier-free pharmaceutical controlled release crystal. In another embodiment, the crystallized binding protein has a greater half-life in vivo than the soluble counterpart of the binding protein. In yet another embodiment, the crystallized binding protein retains biological activity.

In certain embodiments, a binding protein disclosed herein can compete for binding to VEGF, PDGF, and/or a cognate receptor with any of the antibodies, binding proteins, or bispecific antibodies disclosed herein. In certain embodiments, a binding protein disclosed herein can compete for binding with an antibody, binding protein, or bispecific antibody comprising CDRs and/or variable domains selected from those identified in Tables 27, 28, 38-42, or 46-50. In certain embodiments, a binding protein disclosed herein can compete for binding with PR-1610561 (comprising SEQ ID NOs: 131 and 132) or a binding protein comprising the CDRs and/or variable domains of PR-1610561. In certain embodiments, a binding protein disclosed herein can compete for binding with PR-1572102 (comprising SEQ ID NOs: 88 and 89) or PR-1572105 (comprising SEQ ID NOs: 94 and 95) or PR1611292 (comprising SEQ ID NOs: 141 and 142).

According to certain embodiments, a binding protein disclosed herein can bind to the same epitope of VEGF, PDGF, and/or a cognate receptor as any of the antibodies, binding proteins, or bispecific antibodies disclosed herein. In certain embodiments, a binding protein disclosed herein can bind to the same epitope of VEGF, PDGF, and/or a cognate receptor bound by an antibody, binding protein, or bispecific antibody comprising CDRs and/or variable domains selected from those identified in Tables 27, 28, 38-42, or 46-50. In certain embodiments, a binding protein disclosed herein can bind to the same epitope as PR-1610561 (comprising SEQ ID NOs: 131 and 132) or a binding protein comprising the CDRs and/or variable domains of PR-1610561. In certain embodiments, a binding protein disclosed herein binds to the same epitope as PR-1572102 (comprising SEQ ID NOs: 88 and 89) or PR-1572105 (comprising SEQ ID NOs: 94 and 95) or PR1611292 (comprising SEQ ID NOs: 141 and 142).

In certain embodiments, competitive binding can be evaluated using a cross-blocking assay, such as the assay described in ANTIBODIES, A LABORATORY MANUAL, Cold Spring Harbor Laboratory, Ed Harlow and David Lane ($1^{st}$ edition 1988, $2^{nd}$ edition 2014). In some embodiments, competitive binding is identified when a test antibody or binding protein reduces binding of a reference antibody or binding protein (e.g., a binding protein comprising CDRs and/or variable domains selected from those identified in Tables 27, 28, 38-42, or 46-50) to VEGF, PDGF, and/or a cognate receptor by at least about 50% in the cross-blocking assay (e.g., 50%, 60%, 70%, 80%, 90%, 95%, 99%, 99.5%, or more, or any percentage in between), and/or vice versa. In some embodiments, competitive binding can be due to shared or similar (e.g., partially overlapping) epitopes, or due to steric hindrance where antibodies or binding proteins bind at nearby epitopes. See, e.g., Tzartos, Methods in Molecular Biology, vol. 66, Epitope Mapping Protocols, pages 55-66, Humana Press Inc. (1998). In some embodiments, competitive binding can be used to sort groups of binding proteins that share similar epitopes, e.g., those that compete for binding can be "binned" as a group of binding proteins that have overlapping or nearby epitopes, while those that do not compete are placed in a separate group of binding proteins that do not have overlapping or nearby epitopes In an embodiment, the binding protein described herein is glycosylated. For example, the glycosylation pattern may be a human glycosylation pattern.

In various embodiments, a pharmaceutical composition comprising a binding protein disclosed herein and a pharmaceutically acceptable carrier is provided. In a further embodiment, the pharmaceutical composition comprises at least one additional agent such as a therapeutic agent for treating a disorder or a diagnostic agent. For example, the additional agent may be a therapeutic agent, an imaging agent, a cytotoxic agent, an angiogenesis inhibitor (including but not limited to an anti-VEGF antibody or a VEGF-trap), a kinase inhibitor (including but not limited to a KDR and a TIE-2 inhibitor), a co-stimulation molecule blocker (including but not limited to anti-B7.1, anti-B7.2, CTLA4-Ig, anti-CD20), an adhesion molecule blocker (including but not limited to an anti-LFA-1 antibody, an anti-E/L selectin antibody, a small molecule inhibitor), an anti-cytokine antibody or functional fragment thereof (including but not limited to an anti-IL-18, an anti-TNF, and an anti-IL-6/cytokine receptor antibody), methotrexate, cyclosporin, rapamycin, FK506, a detectable label or reporter, a TNF antagonist, an antirheumatic, a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteriod, an anabolic steroid, an erythropoietin, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, or a cytokine antagonist.

In various embodiments, a binding protein disclosed herein binds to VEGF and comprises CDRs and/or variable domains selected from those identified in Tables A, 2.4.1-2.4.9, 27, and 38-42. In some embodiments, the binding protein comprises a CDR set of heavy chain CDRs 1-3 and paired light chain CDRs 1-3 selected from any of the CDR sets listed in Tables A, 2.4.1-2.4.9, 27, and 38-42. In some embodiments, the binding protein comprises a heavy chain variable domain and paired light chain variable domain selected from any of the variable domains listed in Tables A, 2.4.1-2.4.9, 27, and 38-42. In some embodiments, the binding protein is a bispecific or multispecific binding protein, comprising CDRs and/or variable domains selected from Tables A, 2.4.1-2.4.9, 27, and 38-42. The binding protein may further comprise heavy and light chain constant domains selected from Table 3. In some embodiments, the binding protein is also capable of binding to PDGF.

In some embodiments, a binding protein disclosed herein binds to PDGF and comprises CDRs and/or variable domains selected from those identified in Tables A, 1.4.1-1.4.7, 28, and 46-50. In some embodiments, the binding protein comprises a CDR set of heavy chain CDRs 1-3 and paired light chain CDRs 1-3 selected from any of the CDR sets listed in Tables A, 1.4.1-1.4.7, 28, and 46-50. In some embodiments, the binding protein comprises a heavy chain variable domain and paired light chain variable domain selected from any of the variable domains listed in Tables A, 1.4.1-1.4.7, 28, and 46-50. In some embodiments, the binding protein is a bispecific or multispecific binding protein, comprising CDRs and/or variable domains selected from Tables A, 1.4.1-1.4.7, 28, and 46-50. The binding protein may further comprise heavy and light chain constant domains selected from Table 3. In some embodiments, the binding protein is also capable of binding to VEGF.

In some embodiments, a binding protein disclosed herein binds to VEGF and PDGF, wherein the binding site for VEGF comprises CDRs and/or variable domains selected from those identified in Tables A, 2.4.1-2.4.9, 27, and 38-42 and the binding site for PDGF comprises CDRs and/or variable domains selected from those identified in Tables A, 1.4.1-1.4.7, 28, and 46-50. In some embodiments, the binding sites for VEGF and PDGF comprises CDRs and/or variable domains selected from any of the variable domains listed in Tables 56-59, 95, and 96. In some embodiments, binding proteins disclosed herein comprise binding sites for VEGF and PDGF comprising the paired CDRs and/or variable domains from any one of the bispecific binding proteins selected from Tables 56-59, 95, and 96. In some embodiments, the binding proteins are DVD-Ig binding proteins, or any of the other bispecific or multispecific formats disclosed herein. The binding protein described herein may further comprise one or more linkers between the VEGF and PDGF binding sites, wherein the linkers comprise sequences that are selected from Table 55. The binding protein described herein may also comprise heavy and light chain constant domains selected from Table 3.

In some embodiments, a binding protein is capable of binding VEGF and PDGF, wherein the binding site for VEGF comprises CDRs 1-3 from SEQ ID NO: 17 and CDRs-1-3 from SEQ ID NO: 18, and the binding site for PDGF comprises a CDR set of heavy chain CDRs 1-3 and paired light chain CDRs 1-3 selected from any of Tables A, 1.4.1-1.4.7, 28, and 46-50. In some embodiments, the binding site for VEGF comprises CDRs 1-3 from SEQ ID NO: 35 and CDRs-1-3 from SEQ ID NO: 36, and the binding site for PDGF comprises a CDR set of heavy chain CDRs 1-3 and paired light chain CDRs 1-3 selected from any of Tables A, 1.4.1-1.4.7, 28, and 46-50. In some embodiments, the binding site for VEGF comprises CDRs 1-3 from SEQ ID NO: 39 and CDRs-1-3 from SEQ ID NO: 40, and the binding site for PDGF comprises a CDR set of heavy chain CDRs 1-3 and paired light chain CDRs 1-3 selected from any of Tables A, 1.4.1-1.4.7, 28, and 46-50. In some embodiments, the binding site for VEGF comprises SEQ ID NO: 17 and SEQ ID NO: 18, and the binding site for PDGF comprises a heavy chain variable domain and paired light chain variable domain selected from any of the variable domains listed in Tables A, 1.4.1-1.4.7, 28, and 46-50. In some embodiments, the binding site for VEGF comprises SEQ ID NO: 35 and SEQ ID NO: 36, and the binding site for PDGF comprises a heavy chain variable domain and paired light chain variable domain selected from any of the variable domains listed in Tables A, 1.4.1-1.4.7, 28, and 46-50. In some embodiments, the binding site for VEGF comprises SEQ ID NO: 39 and SEQ ID NO: 40, and the binding site for PDGF comprises a heavy chain variable domain and paired light chain variable domain selected from any of the variable domains listed in Tables A, 1.4.1-1.4.7, 28, and 46-50. The binding protein described herein may further comprise one or more linkers between the VEGF and PDGF binding sites, wherein the linkers comprise sequences that are selected from Table 55. The binding protein described herein may also comprise heavy and light chain constant domains selected from Table 3.

In some embodiments, a binding protein is capable of binding VEGF and PDGF, wherein the binding site for PDGF comprises CDRs 1-3 from SEQ ID NO: 1 and CDRs-1-3 from SEQ ID NO: 2, and the binding site for VEGF comprises a CDR set of heavy chain CDRs 1-3 and paired light chain CDRs 1-3 selected from any of Tables A, 2.4.1-2.4.9, 27, and 38-42. In some embodiments, the binding site for PDGF comprises CDRs 1-3 from SEQ ID NO: 15 and CDRs-1-3 from SEQ ID NO: 16, and the binding site for VEGF comprises a CDR set of heavy chain CDRs 1-3 and paired light chain CDRs 1-3 selected from any of Tables A, 2.4.1-2.4.9, 27, and 38-42. In some embodiments, the binding site for PDGF comprises SEQ ID NO: 1 and SEQ ID NO: 2, and the binding site for VEGF comprises a heavy chain variable domain and paired light chain variable domain selected from any of the variable domains listed in Tables A, 2.4.1-2.4.9, 27, and 38-42. In some embodiments, the binding site for PDGF comprises SEQ ID NO: 15 and SEQ ID NO: 16, and the binding site for VEGF comprises a heavy chain variable domain and paired light chain variable domain selected from any of the variable domains listed in Tables A, 2.4.1-2.4.9, 27, and 38-42. The binding protein described herein may further comprise one or more linkers between the VEGF and PDGF binding sites, wherein the linkers comprise sequences that are selected from Table 55. The binding protein described herein may also comprise heavy and light chain constant domains selected from Table 3.

In some embodiments, a binding protein is capable of binding VEGF and PDGF, wherein the binding site for VEGF comprises CDRs 1-3 from SEQ ID NO: 17 and CDRs-1-3 from SEQ ID NO: 18, and the binding site PDGF comprises CDRs 1-3 from SEQ ID NO: 1 and CDRs-1-3 from SEQ ID NO: 2. In some embodiments, the binding site for VEGF comprises CDRs 1-3 from SEQ ID NO: 35 and CDRs-1-3 from SEQ ID NO: 36, and the binding site for PDGF comprises CDRs 1-3 from SEQ ID NO: 15 and CDRs-1-3 from SEQ ID NO: 16. In some embodiments, the binding site for VEGF comprises CDRs 1-3 from SEQ ID NO: 39 and CDRs-1-3 from SEQ ID NO: 40, and the binding site for PDGF comprises CDRs 1-3 from SEQ ID NO: 15 and CDRs-1-3 from SEQ ID NO: 16. The binding protein described herein may further comprise one or more linkers between the VEGF and PDGF binding sites, wherein the linkers comprise sequences that are selected from Table 55. The binding protein described herein may also comprise heavy and light chain constant domains selected from Table 3.

In some embodiments, a binding protein is capable of binding VEGF and PDGF, wherein the binding site for VEGF comprises SEQ ID NO: 17 and SEQ ID NO: 18, and the binding site PDGF comprises SEQ ID NO: 1 and SEQ ID NO: 2. In some embodiments, the binding site for VEGF comprises SEQ ID NO: 35 and SEQ ID NO: 36, and the binding site for PDGF comprises SEQ ID NO: 15 and SEQ ID NO: 16. In some embodiments, the binding site for VEGF comprises SEQ ID NO: 39 and SEQ ID NO: 40, and the binding site for PDGF comprises SEQ ID NO: 15 and SEQ ID NO: 16. The binding protein described herein may further comprise one or more linkers between the VEGF and PDGF binding sites, wherein the linkers comprise sequences that are selected from Table 55. The binding protein described herein may also comprise heavy and light chain constant domains selected from Table 3.

In some embodiments, the binding protein is a DVD-Ig binding protein, capable of binding VEGF and PDGF. In some embodiment, the heavy chain of the binding protein comprises a DVD-Ig heavy chain variable domain and paired DVD-Ig light chain variable domain selected from Tables 56-59, 95, and 96. In some embodiments, the binding protein comprises DVD-Ig heavy and light chain variable domains of SEQ ID NO: 131 and SEQ ID NO: 132. In some embodiments, the binding protein comprises DVD-Ig heavy and light chain variable domains of SEQ ID NO: 88 and SEQ ID NO: 89. In some embodiments, the binding protein comprises DVD-Ig heavy and light chain variable domains of SEQ ID NO: 94 and SEQ ID NO: 95. In some embodiments, the binding protein comprises DVD-Ig heavy and light chain variable domains of SEQ ID NO: 141 and SEQ ID NO: 142. The DVD-Ig binding protein described herein may further comprise heavy and light chain constant domains selected from Table 3.

In certain embodiments, a binding protein disclosed herein is a DVD-Ig binding protein, comprising first and second polypeptide chains of SEQ ID NO: 131 and SEQ ID NO: 132. In some embodiments, the DVD-Ig binding protein comprises first and second polypeptide chains of SEQ ID NO: 88 and SEQ ID NO: 89. In some embodiments, the DVD-Ig binding protein comprises first and second polypeptide chains of SEQ ID NO: 94 and SEQ ID NO: 95. In some embodiments, the DVD-Ig binding protein comprises first and second polypeptide chains of SEQ ID NO: 141 and SEQ ID NO: 142.

Binding Protein Properties

The development and production of a binding protein for use as a human therapeutic agent, e.g., as an anti-inflammatory agent or oncologic agent, may require more than the identification of a binding protein capable of binding to a desired target or targets. The binding proteins disclosed herein exhibit favorable properties in one or more of the following categories (a) the binding kinetics (on-rate, off-rate and affinity) for both the inner and outer antigen-binding domains, (b) potencies in various biochemical and cellular bioassays, (c) in vivo efficacies in relevant tumor models, (d) pharmacokinetic and pharmacodynamics properties, (e) manufacturability, including protein expression level in selected cell lines, scalability, post-translational modification, physicochemical properties such as monomer percentage, solubility, and stability (intrinsic, freeze/thaw, storage stability, etc.), (f) formulation properties, (g) potential immunogenicity risk, (h) toxicological properties, and (i) binding mode and valency. Binding mode and valency may affect binding properties and cellular potencies of a molecule.

The binding proteins disclosed herein exhibit favorable properties in some or each of the categories listed above, including surprisingly high binding affinity at both the VD1 and VD2 positions.

In some embodiments a binding protein or binding proteins disclosed herein targeting VEGF and PDGF serve to both reduce choroidal neovascularization and increase regression of mature vasculature, e.g., in ocular conditions such as AMD. In some embodiments a binding protein or binding proteins disclosed herein targeting VEGF and PDGF neutralize VEGF and PDGF simultaneously. In some embodiments, the binding protein exhibits one or more of high potency to VEGF and/or PDGF, extended ocular duration, and rapid clearance from systemic circulation. In some embodiments, the binding protein is a bispecific and allows for a single injection of an agent to both targets (VEGF and PDGDF), reducing injection volume/frequency while still retaining the drug-like products of a traditional antibody.

In some embodiments, the disclosed binding protein exhibits superior in vivo efficacy (e.g., in a preclinical model of choroidal neovascularization or AMD) as compared to existing treatments for AMD (e.g., Elyea™ and/or Lucentis™). In some embodiments, the disclosed binding protein is a DVD-Ig binding protein and exhibits a high ocular duration. In some embodiments, the DVD-Ig binding protein may be, e.g., 150-200 kDa in weight or greater, and may provide for a longer ocular duration as compared to lower weight agents such as monoclonal antibodies. In some embodiments, the binding protein disclosed herein is a DVD-Ig binding protein and has an ocular half life of at least about 4 days, or at least about 4. 6 days, or at least about 5 days, or at least about 6 days, or at least about 6.5 days, or more. In some embodiments, the DVD-Ig ocular half life is greater than the half-life of an antibody or other construct having a smaller size, while retaining a more rapid systemic clearance similar to that of the antibody. In some embodiments, the DVD-Ig binding protein has an ocular half life of at least about 4 (or at least about 4.6) days after intravitreoius administration at 0.25 mg.

In some embodiments, the disclosed binding proteins are DVD-Ig binding proteins and exhibit improved drug-like properties, including one or more of high thermostability (e.g., a $T_{onset}$ of greater than 50°, 55°, 60°, 61°, 62°, 63°, 64°, or 65° C.), a solubility of at least about 70, 72, 74, 76, 78, or 80 mg/ml, a viscosity at room temperature and at a concentration of 100 mg/ml of about 7.2 centipoise, an effective storage stability in a universal buffer, and/or high freeze-thaw stability. In some embodiments, the DVD-Ig binding protein does not exhibit a significant change in monomer percentage at low concentration after storage at 5° C. or 40° C. for 10, 15, 20, 21, 22, 23, 24, 25, or more days, and/or does not exhibit a significant increase in aggregation at 50-150 mg/ml (or 100+/−10 mg/ml) after 1, 2, 3, 4, 5, or more freeze/thaw cycles.

In certain embodiments, a binding protein exhibiting particularly favorable properties in some or each of the categories listed above is a DVD-Ig binding protein capable of binding VEGF and PDGF, wherein the binding site for VEGF comprises CDRs 1-3 from SEQ ID NO: 35 and CDRs-1-3 from SEQ ID NO: 36, and the binding site for PDGF comprises CDRs 1-3 from SEQ ID NO: 15 and CDRs-1-3 from SEQ ID NO: 16. In an embodiment, the binding site for VEGF comprises SEQ ID NO: 35 and SEQ ID NO: 36, and the binding site for PDGF comprises SEQ ID NO: 15 and SEQ ID NO: 16. In an embodiment, the binding protein is capable of binding VEGF and PDGF, and comprises PR-1610561 (comprising SEQ ID NOs: 131 and 132). In an embodiment, the binding protein comprises a heavy chain constant region on the first polypeptide chain comprising a human IgG1 heavy chain sequence modified by one or more amino acid changes, wherein the changes comprise substitution of leucines at positions 234 and 235 with alanines, and optionally also comprising a substitution of histidine at position 435 with alanine, wherein the amino acid positions are numbered using EU index numbering; and a light chain constant region on the second polypeptide chain comprising a human kappa light chain constant region sequence In certain embodiments, a binding protein exhibiting particularly favorable properties in some or each of the categories listed above is a DVD-Ig binding protein capable of binding VEGF and PDGF, wherein the binding site for VEGF comprises CDRs 1-3 from SEQ ID NO: 17 and CDRs-1-3 from SEQ ID NO: 18, and the binding site for PDGF comprises CDRs 1-3 from SEQ ID NO: 1 and CDRs-1-3 from SEQ ID NO: 2. In an embodiment, the binding site for VEGF comprises SEQ ID NO: 17 and SEQ ID NO: 18, and the binding site for PDGF comprises SEQ ID NO: 1 and SEQ ID NO: 2. In an embodiment, the binding protein is capable of binding VEGF and PDGF, and comprises PR-1572102 (comprising SEQ ID NOs: 88 and 89) or PR-1572105 (comprising SEQ ID NOs: 94 and 95) or PR1611292 (comprising SEQ ID NOs: 141 and 142). In an embodiment, the binding protein comprises a heavy chain constant region on the first polypeptide chain comprising a human IgG1 heavy chain sequence modified by one or more amino acid changes, wherein the changes comprise substitution of leucines at positions 234 and 235 with alanines, and optionally also comprising a substitution of histidine at position 435 with alanine, wherein the amino acid positions are numbered using EU index numbering; and a light chain constant region on the second polypeptide chain comprising a human kappa light chain constant region sequence.

For instance, in some embodiments, the binding protein disclosed herein (e.g., PR-1610561, PR-1572102, PR-1572105, or PR1611292) may exhibit one or more of the following features: enhanced in vivo efficacy in human VEGF transgenic mice, enhanced potency (as measured, e.g., via BIACORE, ELISA, or co-culture sprouting assay), improved expression (e.g., in HEK293 or CHO cells), and improved drug-like properties (e.g., thermal stability, storage stability, solubility, physicochemical properties, and/or pharmacokinetics) as compared to another binding protein or combination of binding proteins targeting VEGF and PDGF.

Preparation of Binding Proteins

In another aspect, the disclosure provides a method of making a binding protein that binds PDGF, VEGF, and/or either or both cognate receptors. In an embodiment, the method of making a binding protein comprises the steps of a) obtaining a first parent antibody, or antigen binding portion thereof, that binds PDGF, VEGF, or a cognate receptor; b) obtaining a second parent antibody, or antigen binding portion thereof, that binds PDGF, VEGF, or a cognate receptor; c) determining the sequences of the variable domains of the parent antibodies or antigen binding portions thereof; d) preparing construct(s) encoding any of the binding proteins described herein using those variable domain sequences; and e) expressing the polypeptide chains, such that a binding protein that binds PDGF, VEGF, and/or either or both cognate receptors is generated.

In any of the embodiments herein, the VD1 heavy chain variable domain, if present, and light chain variable domain, if present, can be from a first parent antibody or antigen binding portion thereof; the VD2 heavy chain variable domain, if present, and light chain variable domain, if present, can be from a second parent antibody or antigen binding portion thereof. The first and second parent antibodies can be the same or different.

In one embodiment, the first parent antibody or antigen binding portion thereof, binds a first antigen, and the second parent antibody or antigen binding portion thereof, binds a second antigen. In an embodiment, the first and second antigens are the same antigen. In another embodiment, the parent antibodies bind different epitopes on the same antigen. In another embodiment, the first and second antigens are different antigens. In another embodiment, the first parent antibody or antigen binding portion thereof, binds the first antigen with a potency different from the potency with which the second parent antibody or antigen binding portion thereof, binds the second antigen. In yet another embodiment, the first parent antibody or antigen binding portion thereof, binds the first antigen with an affinity different from the affinity with which the second parent antibody or antigen binding portion thereof, binds the second antigen.

In another embodiment, the first parent antibody or antigen binding portion thereof, and the second parent antibody or antigen binding portion thereof, are a human antibody, CDR grafted antibody, humanized antibody, and/or affinity matured antibody. The "parent antibody", which provides at least one antigen binding specificity of the multivalent and or multispecific binding protein, may be one that is internalized (and/or catabolized) by a cell expressing an antigen to which the antibody binds; and/or may be an agonist, cell death-inducing, and/or apoptosis-inducing antibody, and the multivalent and or multispecific binding protein as described herein may display improvement(s) in one or more of these properties. Moreover, the parent antibody may lack any one or more of these properties, but may acquire one or more of them when constructed as a multivalent binding protein as described herein. For example, different Fc mutants may prevent FcR, FcR-gamma, complement, or C' binding, or extend half-life.

In various embodiments, an isolated nucleic acid encoding any one of the binding proteins disclosed herein is also provided. Also provided is a composition comprising one or more nucleic acids wherein said one or more nucleic acids encode a nucleic acid encoding any one of the binding proteins disclosed herein. For example, the composition may comprise a nucleic acid that encodes a first polypeptide and a nucleic acid that encodes a second polypeptide, wherein said first and second polypeptide together form a binding protein as described herein. A further embodiment provides a vector (e.g., an expression vector) comprising the isolated nucleic acid disclosed herein. Also provided is a vector (e.g. an expression vector) that comprises one or more nucleic acids that encode a binding protein as described herein. Also provided is a composition comprising one or more vectors that encode a binding protein as described herein. For example, the composition may comprise a vector that encodes a first polypeptide and a vector that encodes a second polypeptide, wherein said first and second polypeptide together form a binding protein as described herein. In some embodiments, the vector is pcDNA; pTT (Durocher et al. (2002) Nucleic Acids Res. 30(2):e9; pTT3 (pTT with additional multiple cloning site; pEFBOS (Mizushima and Nagata (1990) Nucleic Acids Res. 18:17); pBV; pJV; pcDNA3.1 TOPO; pEF6 TOPO; pBOS; pHybE; or pBJ. In an embodiment, the vector is a vector disclosed in U.S. Pat. No. 8,187,836.

In another aspect, a host cell is transformed with the vector disclosed herein. In an embodiment, the host cell is a prokaryotic cell, for example, *E. coli*. In another embodiment, the host cell is a eukaryotic cell, for example, a protist cell, an animal cell, a plant cell, or a fungal cell. In an embodiment, the host cell is a mammalian cell including, but not limited to, CHO, COS, NSO, SP2, PER.C6, or a fungal cell, such as *Saccharomyces cerevisiae*, or an insect cell, such as Sf9. In an embodiment, two or more binding proteins, e.g., with different specificities, are produced in a single recombinant host cell. For example, the expression of a mixture of antibodies has been called Oligoclonics™ (Merus B.V., The Netherlands) disclosed in U.S. Pat. Nos. 7,262,028 and 7,429,486.

In various embodiments, a binding proteins disclosed herein can be prepared by culturing any one of the host cells disclosed herein in a culture medium under conditions sufficient to produce the binding protein.

One embodiment provides a composition for the release of a binding protein wherein the composition comprises a crystallized binding protein, an ingredient, and at least one polymeric carrier. In an embodiment, the polymeric carrier is poly (acrylic acid), a poly (cyanoacrylate), a poly (amino acid), a poly (anhydride), a poly (depsipeptide), a poly (ester), poly (lactic acid), poly (lactic-co-glycolic acid) or PLGA, poly (b-hydroxybutyrate), poly (caprolactone), poly (dioxanone), poly (ethylene glycol), poly ((hydroxypropyl) methacrylamide, poly [(organo)phosphazene], a poly (ortho ester), poly (vinyl alcohol), poly (vinylpyrrolidone), a maleic anhydride-alkyl vinyl ether copolymer, a pluronic polyol, albumin, alginate, cellulose, a cellulose derivative, collagen, fibrin, gelatin, hyaluronic acid, an oligosaccharide, a glycaminoglycan, a sulfated polysaccharide, or blends and copolymers thereof. In an embodiment, the ingredient is albumin, sucrose, trehalose, lactitol, gelatin, hydroxypropyl-β-cyclodextrin, methoxypolyethylene glycol, or polyethylene glycol.

The binding proteins provided herein, such as DVD-Ig binding proteins, may be produced by any of a number of techniques known in the art. For example, expression from host cells, wherein expression vector(s) encoding the DVD-Ig heavy and DVD-Ig light chains is (are) transfected into a host cell by standard techniques. Although it is possible to express the DVD-Ig binding proteins provided herein in either prokaryotic or eukaryotic host cells, DVD-Ig binding proteins are preferably expressed in eukaryotic cells, for example, mammalian host cells.

In an exemplary system for recombinant expression of DVD-Ig proteins, a recombinant expression vector encoding both the DVD-Ig heavy chain and the DVD-Ig light chain is introduced into dhfr-CHO cells by calcium phosphate-mediated transfection. Within the recombinant expression vector, the DVD-Ig heavy and light chain sequences are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD-Ig heavy and light chains and intact DVD-Ig protein is recovered from the culture medium. Standard molecular biology techniques may be used to prepare the recombinant expression vector, transfect the host cells, select for transformants, culture the host cells and recover the DVD-Ig protein from the culture medium. In some embodiments, a method of synthesizing a DVD-Ig binding protein by culturing a host cell provided herein in a suitable culture medium until a DVD-Ig binding protein is synthesized is also provided. The method may further comprise isolating the DVD-Ig protein from the culture medium.

A feature of a DVD-Ig binding protein is that it can be produced and purified in a similar way to a conventional antibody. The design of the full length DVD-Ig binding protein heavy and light chains provided herein leads to assemble primarily to the desired dual-specific multivalent full length binding proteins. In an embodiment, 50%-75% of the binding protein produced by this method is a dual specific tetravalent binding protein (e.g., a DVD-Ig binding protein). In another embodiment, 75%-90% of the binding protein produced by this method is a dual specific tetravalent binding protein. In another embodiment, 90%-95% of the binding protein produced is a dual specific tetravalent binding protein. In some embodiments, at least 50%, at least 75% and at least 90% of the assembled, and expressed dual variable domain immunoglobulin molecules are the desired dual-specific tetravalent protein.

In various embodiments, the disclosure provides methods of expressing a dual variable domain light chain and a dual variable domain heavy chain in a single cell leading to a primary product of a dual-specific tetravalent full length binding protein, where the primary product is more than 50%, such as more than 75% and more than 90%, of all assembled protein, comprising a dual variable domain light chain and a dual variable domain heavy chain.

Therapeutic and Diagnostic Uses

Also disclosed herein, in various embodiments, are methods for diagnosing and treating a mammal (e.g., a human) comprising the step of administering to the mammal, or a sample taken from the mammal, an effective amount of a composition disclosed herein. A binding protein as described herein may be used in a method for therapy or diagnosis.

Given their ability to bind VEGF, PLGF, and/or their cognate receptors, in some embodiments, the binding proteins provided herein can be used to detect one or more of those antigens (e.g., in a biological sample, such as serum or plasma), using a conventional immunoassay, such as an enzyme linked immunosorbent assays (ELISA), a radioimmunoassay (RIA), or tissue immunohistochemistry. The binding protein is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin. An example of a luminescent material is luminol and examples of suitable radioactive materials include $^{3}$H, $^{14}$C, $^{35}$S, $^{90}$Y, $^{99}$Tc, $^{111}$In, $^{125}$I, $^{131}$I, $^{177}$Lu, $^{166}$Ho, and $^{153}$Sm.

In some embodiments, a method is disclosed for treating a human subject suffering from a disorder in which the target, or targets, capable of being bound by the binding proteins disclosed herein is/are detrimental, comprising administering to the human subject a binding protein disclosed herein such that the activity of the target, or targets, in the human subject is inhibited and one or more symptoms is alleviated or treatment is achieved is provided. In various embodiments, treatment comprises reducing, improving, or ameliorating one or more symptom of a disorder. Treatment includes but does not necessarily require curing (i.e., completely eliminating) a disorder or a symptom of a disorder.

The binding proteins provided herein can be used to treat humans suffering from diseases such as, for example, those associated with increased angiogenesis and/or inflammation (e.g., ocular inflammation). In an embodiment, the binding proteins provided herein or antigen-binding portions thereof, are used to treat an autoimmune disorder, asthma, ocular inflammation, Crohn's disease, ulcerative colitis, inflammatory bowel disease (IBD), insulin dependent diabetes mellitus, rheumatoid arthritis, osteoarthritis, systemic lupus erythematosus (SLE), multiple sclerosis, sepsis, a neurodegenerative disease, or an oncological disorder. In an embodiment, a binding protein disclosed herein is used to treat an eye disorder (e.g., an angiogenic eye disorder). In an embodiment, the eye disorder is a macular degeneration, such as wet macular degeneration, dry macular degeneration, age related macular degeneration (AMD), exudative AMD, dry eye, glaucoma, diabetic retinopathy, diabetic macular edema, central retinal vein occlusion, corneal neovascularization, iris neovascularization, neovascular glaucoma, post-surgical fibrosis in glaucoma, proliferative vitreoretinopathy (PVR), choroidal neovascularization, optic disc neovascularization, retinal neovascularization, vitreal neovascularization, pannus, pterygium, macular edema, diabetic macular edema (DME), vascular retinopathy, retinal degeneration, uveitis, keratoconjunctivitis sicca, blepharitis, keratitis or another inflammatory disease of the eye.

In an embodiment, the binding proteins provided herein are capable of neutralizing the activity of their antigen targets both in vitro and in vivo. Accordingly, such binding proteins can be used to inhibit antigen activity, e.g., in a cell culture containing the antigens, in human subjects or in other mammalian subjects having the antigens with which a binding protein provided herein cross-reacts. In another embodiment, a method for reducing antigen activity in a subject suffering from a disease or disorder in which the antigen activity is detrimental is provided. A binding protein provided herein may be administered to a human subject for therapeutic purposes. In some embodiments, the binding protein (e.g., the DVD-Ig binding protein) is administered to a patient, e.g., a patient suffering from wet AMD, and can have one or more effects selected from regressing mature vasculature (e.g., via VEGF binding), reducing choroidal neovascularization (e.g., via VEGF binding), allowing access to blood vessels by stripping off pericytes (e.g., via PDGF binding), and/or providing anti-fibrotic effects to reduce visual loss from scarring (e.g., via PDGF binding). In some embodiments, the binding protein is multispecific for VEGF and PDGF, and is administered at a reduced number of injections and/or a reduced injection frequency, as compared to a combination antibody therapy.

The term "a disorder in which antigen activity is detrimental" encompasses diseases and other disorders in which the presence of the antigen in a subject suffering from the disorder has been shown to be or is suspected of being either responsible for the pathophysiology of the disorder or a factor that contributes to a worsening of the disorder. Accordingly, a disorder in which antigen activity is detrimental is a disorder in which reduction of antigen activity is expected to alleviate the symptoms and/or progression of the disorder. Such disorders may be evidenced, for example, by an increase in the concentration of the antigen in a biological fluid of a subject suffering from the disorder (e.g., an increase in the concentration of antigen in serum, plasma, synovial fluid, etc., of the subject). Non-limiting examples of disorders that can be treated with the binding proteins provided herein include those disorders discussed below and in the section pertaining to pharmaceutical compositions comprising the binding proteins.

Binding proteins disclosed herein, such as the DVD-Ig binding proteins, can be employed in some embodiments for tissue-specific delivery (target a tissue marker and a disease mediator for enhanced local PK thus higher efficacy and/or lower toxicity), including intracellular delivery (targeting an internalizing receptor and an intracellular molecule), delivering through a biological barrier, such as to the inside of the eye or brain (e.g., targeting transferrin receptor and a CNS disease mediator for crossing the blood-brain barrier). The binding proteins may also serve as carrier proteins to deliver an antigen to a specific location via binding to a non-neutralizing epitope of that antigen and also to increase the half-life of the antigen. Furthermore, the binding protein may be designed to either be physically linked to medical devices implanted into patients or target these medical devices (see Burke et al. (2006) Advanced Drug Deliv. Rev. 58(3): 437-446; Hildebrand et al. (2006) Surface and Coatings Technol. 200(22-23): 6318-6324; Drug/device combinations for local drug therapies and infection prophylaxis, Wu (2006) Biomaterials 27(11):2450-2467; Mediation of the cytokine network in the implantation of orthopedic devices, Marques (2005) Biodegradable Systems in Tissue Engineer. Regen. Med. 377-397).

In an embodiment, diseases that can be treated or diagnosed with the compositions and methods disclosed herein include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

Another embodiment provides for the use of the binding protein in the treatment of a disease or disorder, wherein the disorder is arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic poly glandular deficiency type I and polyglandular deficiency type II, Schmidt's syndrome, adult (acute) respiratory distress syndrome, alopecia, alopecia areata, seronegative arthopathy, arthropathy, Reiter's disease, psoriatic arthropathy, ulcerative colitic arthropathy, enteropathic synovitis, chlamydia, yersinia and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasculitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, cholestasis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma) abetalipoproteinemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti cd3 therapy, antiphospholipid syndrome, anti-receptor hypersensitivity reactions, aordic and peripheral aneurysims, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, cor pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic ateriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, epstein-barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, graft rejection of any organ or tissue, gram negative sepsis, gram positive sepsis, granulomas due to intracellular organisms, hairy cell leukemia, Hallerrorden-Spatz disease, hashimoto's thyroiditis, hay fever, heart transplant rejection, hemachromatosis, hemodialysis, hemolytic uremic syndrome/thrombolytic thrombocytopenic purpura, hemorrhage, hepatitis A, His bundle arryhthmias, HIV infection/HIV neuropathy, Hodgkin's disease, hyperkinetic movement disorders, hypersensitity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, legionella, leishmaniasis, leprosy, lesions of the corticospinal system, lipedema, liver transplant rejection, lymphederma, malaria, malignamt Lymphoma, malignant histiocytosis, malignant melanoma, meningitis, meningococcemia, metabolic/idiopathic, migraine headache, mitochondrial multi.system disorder, mixed connective tissue disease, monoclonal gammopathy, multiple myeloma, multiple systems degenerations (Mencel Dejerine-Thomas Shy-Drager and Machado-Joseph), myasthenia gravis, mycobacterium avium intracellulare, mycobacterium tuberculosis, myelodyplastic syndrome, myocardial ischemic disorders, nasopharyngeal carcinoma, neonatal chronic lung disease, nephritis, nephrosis, neurodegenerative diseases, neurogenic I muscular atrophies, neutropenic fever, non-hodgkins lymphoma, occlusion of the abdominal aorta and its branches, occlusive arterial disorders, okt3 therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherlosclerotic disease, peripheral vascular disorders, peritonitis, pernicious anemia, pneumocystis carinii pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynoud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrythmias, spinal ataxia, spinocerebellar degenerations, streptococcal myositis, structural lesions of the cerebellum, Subacute sclerosing panencephalitis, Syncope, syphilis of the cardiovascular system, systemic anaphalaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, vital encephalitis/aseptic meningitis, vital-associated hemaphagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, anaphylaxis, anti-phospholipid antibody syndrome, aplastic anemia, atopic eczema, atopic dermatitis, autoimmune dermatitis, autoimmune disorder associated with streptococcus infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (cis) with risk for multiple sclerosis, childhood onset psychiatric disorder, dacryocystitis, dermatomyositis, diabetic retinopathy, disk herniation, disk prolaps, drug induced immune hemolytic anemia, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratoconjunctivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery, disease (PAD), phlebitis, polyarteritis nodosa (or periarteritis nodosa), polychondritis, polymyalgia rheumatica, poliosis, polyarticular JRA, polyendocrine deficiency syndrome, polymyositis, post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, sneddon-wilkinson dermatosis, spondilitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor, type 1 allergic reaction, type II diabetes, usual interstitial pneumonia (UIP), vernal conjunctivitis, viral retinitis, Vogt-Koyanagi-Harada syndrome (VKH syndrome), wet macular degeneration, wound healing, fibrosis, renal disease, wet macular degeneration, wound healing, age related macular degeneration (AMD), diabetic retinopathy, diabetic macular edema, central retinal vein occlusion, corneal neovascularization, exudative AMD, iris neovascularization, neovascular glaucoma, post-surgical fibrosis in glaucoma, proliferative vitreoretinopathy (PVR), choroidal neovascularization, optic disc neovascularization, retinal neovascularization, vitreal neovascularization, pannus, pterygium, macular edema, diabetic macular edema (DME), vascular retinopathy, retinal degeneration, uveitis, or an inflammatory disease of the eye.

In some embodiments, any one of the binding proteins disclosed herein can be used to treat a disorder listed above. In certain embodiments, the binding protein used to treat any of the disorders discussed herein is one or more of the binding proteins listed in Tables 27-30, 38-42, 46-50, or 55-58. In certain embodiments, the binding protein used to treat any of the disorders discussed herein is one or more of the binding proteins listed in Tables 56-58. In certain embodiments, the binding protein is PR-1572102, PR-1572105, PR-1610561, or PR1611292.

In some embodiments, a binding protein (e.g., PR-1572102, PR-1572105, PR1611292, or PR-1610561) may be used to treat wet AMD that is non-responsive to anti-VEGF monotherapy. For instance, a binding protein targeting VEGF and PDGF (e.g., PR-1572102, PR-1572105, or PR-1610561) may lead to better regression of angiogenesis, thereby providing for a more effective treatment (this does not necessarily mean, however, that such a binding protein would have a reduced administration frequency; whether that is the case is presently unknown). The dual inhibition of both VEGF and PDGF may provide for certain improved treatment outcomes, as compared to anti-VEGF monotherapy.

In another aspect, methods of treating a patient suffering from a disorder are disclosed, comprising the step of administering any one of the binding proteins disclosed herein before, concurrently, or after the administration of a second agent, are provided. In an embodiment, the second agent is an imaging agent, cytotoxic agent, angiogenesis inhibitor, kinase inhibitor, co-stimulation molecule blocker, adhesion molecule blocker, anti-cytokine antibody or functional fragment thereof, methotrexate, cyclosporin, rapamycin, FK506, detectable label or reporter, TNF antagonist, antirheumatic, muscle relaxant, narcotic, non-steroid anti-inflammatory drug (NSAID), analgesic, anesthetic, sedative, local anesthetic, neuromuscular blocker, antimicrobial, antipsoriatic, corticosteriod, anabolic steroid, erythropoietin, immunization, immunoglobulin, immunosuppressive, growth hormone, hormone replacement drug, radiopharmaceutical, antidepressant, antipsychotic, stimulant, asthma medication, beta agonist, inhaled steroid, epinephrine or analog, cytokine, or cytokine antagonist.

Also disclosed, in various embodiments, are anti-idiotype antibodies to the binding proteins disclosed herein. An anti-idiotype antibody includes any protein or peptide-containing molecule that comprises at least a portion of an immunoglobulin molecule such as, but not limited to, at least one complementarily determining region (CDR) of a heavy or light chain or a ligand binding portion thereof, a heavy chain or light chain variable region, a heavy chain or light chain constant region, a framework region, or any portion thereof, that can be incorporated into a binding protein provided herein.

Also disclosed herein, in various embodiments, are methods of determining the presence, amount or concentration of VEGF and/or PDGF, or fragment thereof, in a test sample. In some embodiments, the methods comprise assaying the test sample for the antigen, or fragment thereof, by an immunoassay. The immunoassay (i) employs at least one binding protein and at least one detectable label and (ii) comprises comparing a signal generated by the detectable label as a direct or indirect indication of the presence, amount or concentration of the antigen, or fragment thereof, in the test sample to a signal generated as a direct or indirect indication of the presence, amount or concentration of the antigen, or fragment thereof, in a control or a calibrator. The calibrator is optionally part of a series of calibrators in which each of the calibrators differs from the other calibrators in the series by the concentration of the antigen, or fragment thereof. The method can comprise (i) contacting the test sample with at least one capture agent, which binds to an epitope on the antigen, or fragment thereof, so as to form a capture agent/antigen, or fragment thereof, complex, (ii) contacting the capture agent/antigen, or fragment thereof, complex with at least one detection agent, which comprises a detectable label and binds to an epitope on the antigen, or fragment thereof, that is not bound by the capture agent, to form a capture agent/antigen, or fragment thereof/detection agent complex, and (iii) determining the presence, amount or concentration of the antigen, or fragment thereof, in the test sample based on the signal generated by the detectable label in the capture agent/antigen, or fragment thereof/detection agent complex formed in (ii), wherein at least one capture agent and/or at least one detection agent is the at least one binding protein.

Alternatively, the method may comprise (i) contacting the test sample with at least one capture agent, which binds to an epitope on the antigen, or fragment thereof, so as to form a capture agent/antigen, or fragment thereof, complex, and simultaneously or sequentially, in either order, contacting the test sample with detectably labeled antigen, or fragment thereof, which can compete with any antigen, or fragment thereof, in the test sample for binding to the at least one capture agent, wherein any antigen, or fragment thereof, present in the test sample and the detectably labeled antigen compete with each other to form a capture agent/antigen, or fragment thereof, complex and a capture agent/detectably labeled antigen, or fragment thereof, complex, respectively, and (ii) determining the presence, amount or concentration of the antigen, or fragment thereof, in the test sample based on the signal generated by the detectable label in the capture agent/detectably labeled antigen, or fragment thereof, complex formed in (ii), wherein at least one capture agent is the at least one binding protein and wherein the signal generated by the detectable label in the capture agent/detectably labeled antigen, or fragment thereof, complex is inversely proportional to the amount or concentration of antigen, or fragment thereof, in the test sample.

In some embodiments, the test sample is from a patient, in which case the method can further comprise diagnosing, prognosticating, or assessing the efficacy of therapeutic/prophylactic treatment of the patient. If the method further comprises assessing the efficacy of therapeutic/prophylactic treatment of the patient, the method optionally further comprises modifying the therapeutic/prophylactic treatment of the patient as needed to improve efficacy. The method can be adapted for use in an automated system or a semi-automated system. Accordingly, the methods described herein also can be used to determine whether or not a subject has or is at risk of developing a given disease, disorder or condition. Specifically, such a method can comprise the steps of: (a) determining the concentration or amount in a test sample from a subject of analyte, or fragment thereof, (e.g., using the methods described herein, or methods known in the art); and (b) comparing the concentration or amount of analyte, or fragment thereof, determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of analyte determined in step (a) is unfavorable with respect to the predetermined level, then the subject is determined to have or be at risk for a given disease, disorder or condition.

Additionally, in various embodiments, provided herein are methods of monitoring the progression of disease in a subject. In some embodiments, the method can comprise the steps of: (a) determining the concentration or amount in a test sample from a subject of analyte; (b) determining the concentration or amount in a later test sample from the subject of analyte; and (c) comparing the concentration or amount of analyte as determined in step (b) with the concentration or amount of analyte determined in step (a), wherein if the concentration or amount determined in step (b) is unchanged or is unfavorable when compared to the concentration or amount of analyte determined in step (a), then the disease in the subject is determined to have continued, progressed or worsened. By comparison, if the concentration or amount of analyte as determined in step (b) is favorable when compared to the concentration or amount of analyte as determined in step (a), then the disease in the subject is determined to have discontinued, regressed or improved.

Optionally, the method further comprises comparing the concentration or amount of analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Also provided, in various embodiments, are kits for assaying a test sample for VEGF and/or PDGF, or fragment thereof. The kit may comprise at least one component for assaying the test sample for an antigen, or fragment thereof, and instructions for assaying the test sample for an antigen, or fragment thereof, wherein the at least one component includes at least one composition comprising the binding protein disclosed herein, wherein the binding protein is optionally detectably labeled.

Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including", as well as other forms, such as "includes" and "included", is not limiting. Any range disclosed herein is intended to encompass the endpoints of that range unless stated otherwise.

Generally, nomenclatures used in connection with cell and tissue culture, molecular biology, immunology, microbiology, genetics and protein and nucleic acid chemistry and hybridization described herein are those known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

That the disclosure may be more readily understood, select terms are defined below.

The term "antibody" refers to an immunoglobulin (Ig) molecule, which is may comprise four polypeptide chains, two heavy (H) chains and two light (L) chains, or it may comprise a functional fragment, mutant, variant, or derivative thereof, that retains the epitope binding features of an Ig molecule. Such fragment, mutant, variant, or derivative antibody formats are known in the art. In an embodiment of a full-length antibody, each heavy chain is comprised of a heavy chain variable region (VH) and a heavy chain constant region (CH). In the case of an IgG molecule, the CH comprises three domains, CH1, CH2 and CH3. Each light chain is comprised of a light chain variable region (VL) and a light chain constant region (CL). The CL is comprised of a single CL domain. The VH and VL can be further subdivided into regions of hypervariability, termed complementarity determining regions (CDRs), interspersed with regions that are more conserved, termed framework regions (FRs). Generally, each VH and VL is composed of three CDRs and four FRs, arranged from amino-terminus to carboxy-terminus in the following order: FR1, CDR1, FR2, CDR2, FR3, CDR3, and FR4. CDR regions may be determined by standard methods, e.g., those of Kabat et al. Immunoglobulin molecules can be of any type (e.g., IgG, IgE, IgM, IgD, IgA and IgY), class (e.g., IgG1, IgG2, IgG3, IgG4, IgA1 and IgA2), or subclass.

The term "bispecific antibody" refers to an antibody that binds one antigen (or epitope) on one of its two binding arms (one pair of HC/LC), and binds a different antigen (or epitope) on its second binding arm (a different pair of HC/LC). A bispecific antibody is a type of bispecific binding protein. A bispecific antibody may have two distinct antigen binding arms (in both specificity and CDR sequences), and may be monovalent for each antigen to which it binds. Bispecific antibodies include those generated by quadroma technology (Milstein and Cuello (1983) Nature 305(5934): 537-40), by chemical conjugation of two different monoclonal antibodies (Staerz et al. (1985) Nature 314(6012): 628-31), or by knob-into-hole or similar approaches which introduces mutations in the Fc region (Holliger et al. (1993) Proc. Natl. Acad. Sci. USA 90(14): 6444-6448).

The term "affinity matured" refers to an antibody or binding protein with one or more alterations in one or more CDR or framework (FR) regions thereof, which may result in an improvement in the affinity for an antigen, compared to a parent antibody or binding protein which does not possess those alteration(s). Exemplary affinity matured antibodies or binding protein will have nanomolar or even picomolar affinities for the target antigen. Affinity matured antibodies or binding protein may be produced by procedures known in the art, e.g., Marks et al. (1992) BioTechnology 10:779-783 describes affinity maturation by VH and VL domain shuffling. Random mutagenesis of CDR and/or framework residues is described by Barbas et al. (1994) Proc. Nat. Acad. Sci. USA 91:3809-3813; Schier et al. (1995) Gene 169:147-155; Yelton et al. (1995) J. Immunol. 155:1994-2004; Jackson et al. (1995) J. Immunol. 154(7): 3310-9; Hawkins et al. (1992) J. Mol. Biol. 226:889-896 and mutation at selective mutagenesis positions, contact or hypermutation positions with an activity enhancing amino acid residue as described in U.S. Pat. No. 6,914,128.

The term "CDR-grafted" refers to an antibody or binding protein that comprises heavy and light chain variable region sequences in which the sequences of one or more of the CDR regions of VH and/or VL are replaced with CDR sequences of another antibody or binding protein. For example, the two antibodies or binding protein can be from different species, such as antibodies or binding protein having murine heavy and light chain variable regions in which one or more of the murine CDRs has been replaced with human CDR sequences.

The term "humanized" refers to an antibody or binding protein from a non-human species that has been altered to be more "human-like", i.e., more similar to human germline sequences. One type of humanized antibody or binding protein is a CDR-grafted antibody or binding protein, in which non-human CDR sequences are introduced into human VH and VL sequences to replace the corresponding human CDR sequences. A humanized antibody or binding protein also encompasses a variant, derivative, analog or fragment of an antibody or binding protein that comprises framework region (FR) sequences having substantially (e.g., at least 80%, at least 85%, at least 90%, at least 95%, at least 98% or at least 99% identity to) the amino acid sequence of a human antibody and at least one CDR having substantially the amino acid sequence of a non-human antibody. A humanized antibody or binding protein may comprise substantially all of at least one variable domain (Fab, Fab', F(ab') 2, FabC, Fv) in which the sequence of all or substantially all of the CDR regions correspond to those of a non-human immunoglobulin (i.e., donor antibody) and the sequence of all or substantially all of the FR regions are those of a human immunoglobulin. The humanized antibody or binding protein also may include the CH1, hinge, CH2, CH3, and/or CH4 regions of the heavy chain. In an embodiment, a humanized antibody or binding protein may also comprise at least a portion of a human immunoglobulin Fc region. In some embodiments, a humanized antibody or binding protein only contains a humanized light chain. In some embodiments, a humanized antibody or binding protein only contains a humanized heavy chain. In some embodiments, a humanized antibody or binding protein only contains a humanized variable domain of a light chain and/or humanized variable domain of a heavy chain. In some embodiments, a humanized antibody or binding protein contains a humanized light chain as well as at least a variable domain of a heavy chain. In some embodiments, a humanized antibody or binding protein contains a humanized heavy chain as well as at least a variable domain of a light chain.

The term "anti-idiotypic antibody" refers to an antibody raised against the amino acid sequence of the antigen combining site of another antibody. Anti-idiotypic antibodies may be administered to enhance an immune response against an antigen.

The term "biological activity" refers to any one or more biological properties of a molecule (whether present naturally as found in vivo, or provided or enabled by recombinant means). Biological properties include, but are not limited to, binding a receptor, inducing cell proliferation, inhibiting cell growth, inducing other cytokines, inducing apoptosis, and enzymatic activity.

The term "neutralizing" refers to counteracting the biological activity of an antigen when a binding protein specifically binds to the antigen. In an embodiment, a neutralizing binding protein binds to an antigen (e.g., VEGF and/or PDGF or their receptors) and reduces the antigen's biological activity by at least about 20%, about 40%, about 60%, about 80%, about 85%, about 90%, about 95%, or about 100% (or any percentage in between).

The term "specificity" refers to the ability of a binding protein to selectively bind an antigen.

The term "affinity" refers to the strength of the interaction between a binding protein and an antigen, and is determined by the sequence of the CDRs of the binding protein as well as by the nature of the antigen, such as its size, shape, and/or charge. Binding proteins may be selected for affinities that provide desired therapeutic end-points while minimizing negative side-effects. Affinity may be measured using methods known to one skilled in the art (see, e.g., U.S. Patent Appl. No. 20090311253 and U.S. Pat. No. 7,612,181).

The term "potency" refers to the ability of a binding protein to achieve a desired effect, and is a measurement of its therapeutic efficacy. Potency may be assessed using methods known to one skilled in the art (see, e.g., U.S. Patent Appl. No. 20090311253 and U.S. Pat. No. 7,612,181).

The term "cross-reactivity" refers to the ability of a binding protein to bind a target other than that against which it was raised. Generally, a binding protein will bind its target tissue(s)/antigen(s) with an appropriately high affinity, but will display an appropriately low affinity for non-target normal tissues. Methods of assessing cross-reactivity are known to one skilled in the art (see, e.g., U.S. Patent Appl. No. 20090311253 and U.S. Pat. No. 7,612,181).

The term "biological function" refers the specific in vitro or in vivo actions of a binding protein. Binding proteins may target several classes of antigens and achieve desired therapeutic outcomes through multiple mechanisms of action. Binding proteins may target soluble proteins, cell surface antigens, as well as extracellular protein deposits. Binding proteins may agonize, antagonize, or neutralize the activity of their targets. Binding proteins may assist in the clearance of the targets to which they bind, or may result in cytotoxicity when bound to cells. Portions of two or more antibodies may be incorporated into a multivalent format to achieve distinct functions in a single binding protein molecule. The in vitro assays and in vivo models used to assess biological function are known to one skilled in the art (see, e.g., U.S. Patent Appl. No. 20090311253 and U.S. Pat. No. 7,612,181).

A "stable" binding protein refers to one in which the binding protein retains some level of its physical stability, chemical stability and/or biological activity upon storage. Methods of stabilizing binding proteins and assessing their stability at various temperatures are known to one skilled in the art (see, e.g., U.S. Patent Appl. No. 20090311253 and U.S. Pat. No. 7,612,181).

The term "solubility" refers to the ability of a protein to remain dispersed within an aqueous solution. The solubility of a protein in an aqueous formulation depends upon the proper distribution of hydrophobic and hydrophilic amino acid residues, and therefore, solubility can correlate with the production of correctly folded proteins. A person skilled in the art will be able to detect an increase or decrease in solubility of a binding protein using routine HPLC techniques and methods known to one skilled in the art (see, e.g., U.S. Patent Appl. No. 20090311253 and U.S. Pat. No. 7,612,181).

Binding proteins may be produced using a variety of host cells or may be produced in vitro, and the relative yield per effort determines the "production efficiency." Factors influencing production efficiency include, but are not limited to, host cell type (prokaryotic or eukaryotic), choice of expression vector, choice of nucleotide sequence, and methods employed. The materials and methods used in binding protein production, as well as the measurement of production efficiency, are known to one skilled in the art (see, e.g., U.S. Patent Appl. No. 20090311253 and U.S. Pat. No. 7,612,181).

The term "immunogenicity" means the ability of a substance to induce an immune response. Administration of a therapeutic binding protein may result in a certain incidence of an immune response. Potential elements that might induce immunogenicity in a multivalent format may be analyzed during selection of the parental antibodies, and steps to reduce such risk can be taken to optimize the parental antibodies prior to incorporating their sequences into a multivalent binding protein format. Methods of reducing the immunogenicity of antibodies and binding proteins are known to one skilled in the art (U.S. Patent Appl. No. 20090311253 and U.S. Pat. No. 7,612,181).

The terms "label" and "detectable label" refer to a moiety attached to a member of a specific binding pair, such as an antibody/binding protein or its analyte to render a reaction (e.g., binding) between the members of the specific binding pair, detectable. The labeled member of the specific binding pair is referred to as "detectably labeled." Thus, the term "labeled binding protein" refers to a protein with a label incorporated that provides for the identification of the binding protein. In an embodiment, the label is a detectable marker that can produce a signal that is detectable by visual or instrumental means, e.g., incorporation of a radiolabeled amino acid or attachment to a polypeptide of biotinyl moieties that can be detected by marked avidin (e.g., streptavidin containing a fluorescent marker or enzymatic activity that can be detected by optical or colorimetric methods). Examples of labels for polypeptides include, but are not limited to, the following: radioisotopes or radionuclides (e.g., $^{3}$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm); chromogens, fluorescent labels (e.g., FITC, rhodamine, lanthanide phosphors), enzymatic labels (e.g., horseradish peroxidase, luciferase, alkaline phosphatase); chemiluminescent markers; biotinyl groups; predetermined polypeptide epitopes recognized by a secondary reporter (e.g., leucine zipper pair sequences, binding sites for secondary antibodies, metal binding domains, epitope tags); and magnetic agents, such as gadolinium chelates. Representative examples of labels commonly employed for immunoassays include moieties that produce light, e.g., acridinium compounds, and moieties that produce fluorescence, e.g., fluorescein. In this regard, the moiety itself may not be detectably labeled but may become detectable upon reaction with yet another moiety.

The term "conjugate" refers to a binding protein that is chemically linked to a second chemical moiety, such as a therapeutic or cytotoxic agent. The term "agent" includes a chemical compound, a mixture of chemical compounds, a biological macromolecule, or an extract made from biological materials. In an embodiment, the therapeutic or cytotoxic agents include, but are not limited to, pertussis toxin, taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. When employed in the context of an immunoassay, the conjugate antibody may be a detectably labeled antibody used as the detection antibody.

The terms "crystal" and "crystallized" refer to a binding protein (e.g., an antibody), or antigen binding portion thereof, that exists in the form of a crystal. Crystals are one form of the solid state of matter, which is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. (See Giege and Ducruix (1999) CRYSTALLIZATION OF NUCLEIC ACIDS AND PROTEINS, A PRACTICAL APPROACH, 2nd ed., pp. 20 1-16, Oxford University Press, NY, N.Y.).

The term "vector" refers to a nucleic acid molecule capable of transporting another nucleic acid to which it has been linked One type of vector is a "plasmid," which refers to a circular double stranded DNA loop into which additional DNA segments may be ligated. Another type of vector is a viral vector, wherein additional DNA segments may be ligated into the viral genome. Other vectors include RNA vectors. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Certain vectors are capable of directing the expression of genes to which they are operatively linked Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, other forms of expression vectors are also included, such as viral vectors (e.g., replication defective retroviruses, adenoviruses and adeno-associated viruses), which serve equivalent functions. A group of pHybE vectors (e.g., U.S. Pat. No. 8,187,836) may be used for parental antibody and DVD-binding protein cloning. V1, derived from pJP183; pHybE-hCg1,z,non-a V2; and pJP184, may be used for cloning of antibody and DVD heavy chains with a wild type constant region or modified constant region (e.g., a L234, L235, H435A modified IgG1 constant region). V2, derived from pJP191 (with or without modifications to the Kozak site); pHybE-hCk V3, may be used for cloning of antibody and DVD light chains with a kappa constant region. V3, derived from pJP192; pHybE-hCl V2, may be used for cloning of antibody and DVD light chains with a lambda constant region. V4, built with a lambda signal peptide and a kappa constant region, may be used for cloning of DVD light chains with a lambda-kappa hybrid V domain. V5, built with a kappa signal peptide and a lambda constant region, may be used for cloning of DVD light chains with a kappa-lambda hybrid V domain. V7, derived from pJP183; pHybE-hCg1,z,non-a V2, may be used for cloning of antibody and DVD heavy chains with a (234,235 AA) mutant constant region.

The terms "recombinant host cell" or "host cell" refer to a cell into which exogenous, e.g., recombinant, DNA has been introduced. Such terms refer not only to the particular subject cell, but to the progeny of such a cell. Because certain modifications may occur in succeeding generations due to either mutation or environmental influences, such progeny may not, in fact, be identical to the parent cell, but are still included within the scope of the term "host cell" as used herein. In an embodiment, host cells include prokaryotic and eukaryotic cells. In an embodiment, eukaryotic cells include protist, fungal, plant and animal cells. In another embodiment, host cells include but are not limited to the prokaryotic cell line *E. coli*; mammalian cell lines CHO, HEK 293, COS, NSO, SP2 and PER.C6; the insect cell line Sf9; and the fungal cell *Saccharomyces cerevisiae.*

The term "transfection" encompasses a variety of techniques commonly used for the introduction of exogenous nucleic acid (e.g., DNA) into a host cell, e.g., electroporation, calcium-phosphate precipitation, DEAE-dextran transfection and the like.

The term "cytokine" refers to a protein released by one cell population that acts on another cell population as an intercellular mediator. The term "cytokine" includes proteins from natural sources or from recombinant cell culture and biologically active equivalents of the native sequence cytokines.

The term "biological sample" refers to a quantity of a substance from a living thing or formerly living thing Such substances include, but are not limited to, blood, plasma, serum, urine, amniotic fluid, synovial fluid, endothelial cells, leukocytes, monocytes, other cells, organs, tissues, bone marrow, lymph nodes and spleen.

The term "component" refers to an element of a composition. In relation to a diagnostic kit, for example, a component may be a capture antibody, a detection or conjugate antibody, a control, a calibrator, a series of calibrators, a sensitivity panel, a container, a buffer, a diluent, a salt, an enzyme, a co-factor for an enzyme, a detection reagent, a pretreatment reagent/solution, a substrate (e.g., as a solution), a stop solution, and the like that can be included in a kit for assay of a test sample. Thus, a "component" can include a polypeptide or other analyte as above, that is immobilized on a solid support, such as by binding to an anti-analyte (e.g., anti-polypeptide) antibody. Some components can be in solution or lyophilized for reconstitution for use in an assay.

"Control" refers to a composition known to not analyte ("negative control") or to contain analyte ("positive control"). A positive control can comprise a known concentration of analyte. A "positive control" can be used to establish assay performance characteristics and is a useful indicator of the integrity of reagents (e.g., analytes).

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) may be generally applicable.

"Pretreatment reagent," e.g., lysis, precipitation and/or solubilization reagent, as used in a diagnostic assay as described herein refers to one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

The term "specific binding partner" refers to a member of a specific binding pair. A specific binding pair comprises two different molecules that specifically bind to each other through chemical or physical means. Therefore, in addition to antigen and antibody specific binding, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, and antibodies, including monoclonal and polyclonal antibodies as well as complexes, fragments, and variants (including fragments of variants) thereof, whether isolated or recombinantly produced.

The term "Fc region" refers to the C-terminal region of an immunoglobulin heavy chain, which may be generated by papain digestion of an intact antibody or binding protein. The Fc region may be a native sequence Fc region or a variant Fc region. The Fc region of an immunoglobulin generally comprises two constant domains, a CH2 domain and a CH3 domain, and optionally comprises a CH4 domain. Replacements of amino acid residues in the Fc portion to alter effector function are known in the art (e.g., U.S. Pat. Nos. 5,648,260 and 5,624,821). The Fc region mediates several important effector functions, e.g., cytokine induction, antibody dependent cell mediated cytotoxicity (ADCC), phagocytosis, complement dependent cytotoxicity (CDC), and half-life/clearance rate of antibody or binding protein and antigen-antibody or antigen-binding protein complexes. In some cases these effector functions are desirable for a therapeutic immunoglobulin but in other cases might be unnecessary or even deleterious, depending on the therapeutic objectives.

The term "antigen-binding portion" of a binding protein refers to one or more fragments of a binding protein that retain the ability to specifically bind to an antigen. The antigen-binding function of a binding protein may be performed by fragments of a full-length binding protein, including bispecific, dual specific, or multi-specific formats; for instance, binding to two or more different antigens. Examples of binding fragments encompassed within the term "antigen-binding portion" of an binding protein include (i) an Fab fragment, a monovalent fragment consisting of the VL, VH, CL and CH1 domains; (ii) an F(ab')$_2$ fragment, a bivalent fragment comprising two Fab fragments linked by a disulfide bridge at the hinge region; (iii) an Fd fragment consisting of the VH and CH1 domains; (iv) an Fv fragment consisting of the VL and VH domains of a single arm of an antibody or binding protein, (v) a dAb fragment, which comprises a single variable domain; and (vi) an isolated complementarity determining region (CDR). Furthermore, although the two domains of the Fv fragment, VL and VH, are encoded by separate genes, they may be joined, e.g., using recombinant methods, by a synthetic linker that enables them to be made as a single protein chain in which the VL and VH regions pair to form monovalent molecules (known as single chain Fv (scFv). Such single chain antibodies or binding proteins are also intended to be encompassed within the term "antigen-binding portion" of an antibody or binding protein. Other forms of single chain antibodies, such as diabodies are also encompassed. In addition, single chain antibodies or binding protein also include "linear" antibodies or binding protein comprising a pair of tandem Fv segments (VH-CH1-VH-CH1) which, together with complementary light chain polypeptides, form a pair of antigen binding regions.

The term "multivalent binding protein" refers to a binding protein comprising two or more antigen binding sites. In an embodiment, the multivalent binding protein is engineered to have three or more antigen binding sites, and may not be a naturally occurring antibody. The term "multispecific binding protein" refers to a binding protein capable of binding two or more related or unrelated targets. In an embodiment, the dual variable domain (DVD) binding proteins provided herein comprise two or more antigen binding sites and are tetravalent or multivalent binding proteins.

The term "linker" refers to an amino acid residue or a polypeptide comprising two or more amino acid residues joined by peptide bonds that are used to link two polypeptides (e.g., two VH or two VL domains) Such linker polypeptides are well known in the art (see, e.g., Holliger et al. (1993) Proc. Natl. Acad. Sci. USA 90:6444-6448; Poljak et al. (1994) Structure 2:1121-1123). A number of suitable linkers for use in the binding proteins described herein are set out in Table 55. In some embodiments, the X1 linker on the heavy chain is a GS-H10 linker and the X1 linker on the light chain is a GS-L10(dR) linker. In some embodiments, the X1 linker on the heavy chain is a GS-H10 linker and the X1 linker on the light chain is a GS-L10 linker. In some embodiments, the X1 linker on the heavy chain is an HG-short linker and the X1 linker on the light chain is an LK-long linker.

The terms "Kabat numbering", "Kabat definitions" and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody or binding protein, or an antigen binding portion thereof (Kabat et al. (1971) Ann. NY Acad. Sci. 190:382-391 and, Kabat et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3. In some embodiments, the CDR sequences, framework sequences, and or constant region sequences are identified using Kabat numbering.

The term "CDR" refers to a complementarity determining region within an immunoglobulin variable region sequence. There are three CDRs in each of the variable regions of the heavy chain and the light chain, which are designated CDR1, CDR2 and CDR3, for each of the heavy and light chain variable regions. The term "CDR set" refers to a group of three CDRs that occur in a single variable region capable of binding the antigen. The exact boundaries of these CDRs have been defined differently according to different systems. The system described by Kabat (Kabat et al. (1987) and (1991)) not only provides an unambiguous residue numbering system applicable to any variable region of an antibody or binding protein, but also provides precise residue boundaries defining the three CDRs in each heavy or light chain sequence. These CDRs may be referred to as Kabat CDRs. Chothia and coworkers (Chothia and Lesk (1987) J. Mol. Biol. 196:901-917; Chothia et al. (1989) Nature 342:877-883) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan (1995) FASEB J. 9:133-139 and MacCallum (1996) J. Mol. Biol. 262(5):732-45). Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs.

The term "epitope" refers to a region of an antigen that is specifically bound by a binding protein disclosed herein. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An antigen or fragment can contain more than one epitope. An epitope may be determined by obtaining an X-ray crystal structure of an antibody:antigen complex and determining which residues on the antigen (e.g., VEGF or PDGF or a receptor) are within a specified distance of residues on the antibody of interest, wherein the specified distance is, 5 Å or less, e.g., 5 Å, 4 Å, 3 Å, 2 Å, 1 Å or less, or any distance in between. In some embodiments, the epitope is defined as a stretch of 8 or more contiguous amino acid residues along the antigen sequence in which at least 50%, 70% or 85% of the residues are within the specified distance of the antibody or binding protein in the X-ray crystal structure.

In certain embodiments, a binding protein specifically binds an antigen when it preferentially recognizes its target antigen in a complex mixture of proteins and/or macromolecules. Binding proteins that bind to the same or similar epitopes will likely cross-compete (one prevents the binding or modulating effect of the other). Cross-competition, however, can occur even without partial or complete epitope overlap, e.g., if epitopes are adjacent in three-dimensional space and/or due to steric hindrance.

The term "pharmacokinetic(s)" refers to the process by which a drug is absorbed, distributed, metabolized, and excreted by an organism. To generate a multivalent binding protein molecule with a desired pharmacokinetic profile, parent monoclonal antibodies with similarly desired pharmacokinetic profiles are selected. The PK profiles of the selected parental monoclonal antibodies can be easily determined in rodents using methods known to one skilled in the art (see, e.g., U.S. Pat. No. 7,612,181).

The term "bioavailability" refers to the degree and rate at which a drug is absorbed into a living system or is made available at the site of physiological activity. Bioavailability can be a function of several of the previously described properties, including stability, solubility, immunogenicity and pharmacokinetics, and can be assessed using methods known to one skilled in the art (see, e.g., U.S. Pat. No. 7,612,181).

The term "surface plasmon resonance" refers to an optical phenomenon that allows for the analysis of real-time biospecific interactions by detection of alterations in protein concentrations within a biosensor matrix, for example using the BIAcore® system (BIAcore International AB, a GE Healthcare company, Uppsala, Sweden and Piscataway, N.J.). For further descriptions, see Jönsson et al. (1993) Ann. Biol. Clin. 51:19-26. The term "$K_{on}$" refers to the on rate constant for association of a binding protein (e.g., an antibody or DVD-Ig) to the antigen to form the, e.g., DVD-Ig/antigen complex. The term "$K_{on}$" also refers to "association rate constant", or "ka", as is used interchangeably herein. This value indicating the binding rate of a binding protein to its target antigen or the rate of complex formation between a binding protein, e.g., an antibody, and antigen also is shown by the equation below:

Antibody ("Ab")+Antigen ("Ag")→Ab-Ag

The term "$K_{off}$" refers to the off rate constant for dissociation, or "dissociation rate constant", of a binding protein (e.g., an antibody or DVD-Ig) from the, e.g., DVD-Ig/antigen complex as is known in the art. This value indicates the dissociation rate of a binding protein, e.g., an antibody, from its target antigen or separation of Ab-Ag complex over time into free antibody and antigen as shown by the equation below:

Ab+Ag←Ab-Ag

The terms "$K_d$" and "equilibrium dissociation constant" may refer to the value obtained in a titration measurement at equilibrium, or by dividing the dissociation rate constant ($K_{off}$) by the association rate constant ($K_{on}$). The association rate constant, the dissociation rate constant and the equilibrium dissociation constant, are used to represent the binding affinity of a binding protein (e.g., an antibody or DVD-Ig) to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay, can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.), can also be used.

The term "variant" refers to a polypeptide that differs from a given polypeptide in amino acid sequence by the addition (e.g., insertion), deletion, or conservative substitution of amino acids, but that retains the biological activity of the given polypeptide (e.g., a variant VEGF antibody can compete with anti-VEGF antibody for binding to VEGF). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al. (1982) J. Mol. Biol. 157: 105-132). The hydropathic index of an amino acid is based on a consideration of its hydrophobicity and charge. It is known in the art that amino acids of similar hydropathic indexes in a protein can be substituted and the protein still retains protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101). Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. The term "variant" also includes polypeptide or fragment thereof that has been differentially processed, such as by proteolysis, phosphorylation, or other post-translational modification, yet retains its biological activity or antigen reactivity, e.g., the ability to bind to VEGF. The term "variant" encompasses fragments of a variant unless otherwise defined. A variant may be about 99%, 98%, 97%, 96%, 95%, 94%, 93%, 92%, 91%, 90%, 89%, 88%, 87%, 86%, 85%, 84%, 83%, 82%, 81%, 80%, 79%, 78%, 77%, 76%, or 75% identical to the wild type sequence.

Use of Disclosed Binding Proteins in Treating Various Diseases

The binding protein molecules provided herein are useful as therapeutic molecules to treat various diseases, e.g., wherein the targets that are recognized by the binding proteins are detrimental. Such binding proteins may bind one or more targets involved in a specific disease.

Without limiting the disclosure, further information on certain disease conditions is provided.

1. Age-Related Macular Degeneration (AMD)

In various embodiments, one or more of the binding proteins disclosed herein that are capable of binding to VEGF and PDGF and/or their cognate receptors (e.g., a combination of an anti-VEGF and an anti-PDGF binding protein, or a multispecific binding protein capable of targeting both VEGF and PDGF) can be used to treat AMD. In some embodiments, any of the binding proteins disclosed herein can be used to treat AMD, or a binding protein comprising the CDR and/or variable domain sequences from any of the binding disclosed herein. In certain embodiments, the binding protein used to treat AMD is one or more of the binding proteins listed in Tables 27-30, 38-42, 46-50, or 55-58. In certain embodiments, the binding protein used to treat AMD is one or more of the binding proteins listed in Tables 56-58. In certain embodiments, the binding protein is PR-1572102, PR-1572105, or PR-1610561.

Age-Related Macular Degeneration (AMD) is the leading cause of irreversible vision loss in individuals over the age of 50 in the United States and a major cause of blindness worldwide. Globally more than 160 million people suffer from AMD. AMD is an age-related ocular disease that results in blindness due to damage to the macula; the region of the retina responsible for sharp central vision. It is associated with the degeneration of the macula and in particular the retinal pigmented epithelium (RPE).

The disease occurs in two forms, the dry or non-exudative AMD form and the wet or exudative form. The most common form of macular degeneration, dry AMD (non-neovascular), is an early stage of the disease and may result from aging and thinning of macular tissues, deposition of pigment in the macula, or a combination of both processes. Dry AMD is diagnosed when yellowish spots known as drusen accumulate in and around the macula. Drusen are thought to be deposits or debris from nearby deteriorating tissue. The onset of dry AMD is usually associated with age-related changes in Bruch's membrane, a highly specialized matrix for adhesion of retinal pigment epithelial (RPE) cells. These alterations in Bruch's membrane can result in death of RPE cells in the macula, accumulation of drusen, and damage to photoreceptor cells. Gradual central loss of vision may occur with dry AMD, but the symptoms are typically not nearly as severe as with the wet form of the disease. Dry AMD can slowly progress to late-stage geographic atrophy (GA) resulting in a gradual deterioration of retinal cells that can cause severe vision loss. Dry AMD (both early and late stage) is the most common form of AMD representing more than 85% of all diagnosed cases.

The wet or exudative form of the disease usually results in more severe vision loss. Wet macular degeneration mainly affects central vision, causing "blind spots" in the central line of vision. Approximately 10-15% of dry AMD cases progress to wet AMD. Wet AMD is characterized by new blood vessel growth beneath the retina. Clinically, this is referred to as choroidal neovascularization (CNV). Wet AMD accounts for about 10-15% of all cases of AMD. Progression of dry AMD to wet AMD is marked by the development of neovascularization within Bruch's membrane, as well as in the subretinal space. Wet AMD occurs when abnormal blood vessels behind the retina grow under the macula. These new blood vessels tend to be fragile and often leak blood and fluid. The blood and fluid result in macula inflammation and thickening and disrupts the connection between the photoreceptors and the RPE, leading to vision loss. In wet AMD, neovascularization is stimulated by many angiogenic factors; including vascular endothelial growth factor (VEGF), which appears to be the primary angiogenic factor in patients with wet AMD (Miller et al. (1994) Am. J. Pathol. 145(3):574-584). Additionally, VEGF can act as a powerful endothelial cell mitogen, increasing vascular permeability. The primary goals of current AMD treatment are to block or inhibit choroidal neovascularization (CNV) and macular edema following retinal vein occlusion (RVO), stabilize or improve vision, and to reduce the occurrence of adverse effects.

Anti-VEGF agents may reduce choroidal neovascularization (CNV) and leakage, but do not lead to regression of CNV itself. Emerging evidence indicates the important role of pericytes on the maturation of new blood vessels. Anti-PDGF agents can directly block pericyte recruitment and prevent the maturation and stabilization of choroidal neovascularization. If pericytes can be stripped away from new blood vessels, vascular endothelial cells may become more susceptible to VEGF blockade, ultimately leading to a regression of angiogenesis.

Among other functions, VEGF stimulates endothelial cell proliferation/growth, increases vascular permeability, and promotes leukocyte activity capable of damaging retinal endothelial cells (Leung et al. (1989) Science 246(4935): 1306-9). In wet AMD, retinal tissues produce and release angiogenic growth factors such as VEGF that bind to specific receptors located on the endothelial cells of nearby preexisting blood vessels. Activation of endothelial cells can result in the release of enzymes targeting tight junctions. These enzymes act on the basement membrane surrounding all existing blood vessels and lead to the formation of holes in the membrane. The endothelial cells proliferate and migrate out through these holes toward the diseased tissue. Specialized adhesion molecules such as integrins promote formation of new blood vessel sprouts, and matrix metalloproteinases (MMPs) dissolve the tissue in front of the sprouting vessel tip in order to accommodate it. Finally, smooth muscle cells (pericytes) provide structural support to these newly formed blood vessel loops and blood flow begins in these new immature vessels. Thus, VEGF may serve as a rate-limiting step in angiogenesis. VEGF also increases vascular permeability by leukocyte-mediated endothelial cell injury, formation of fenestrations, and the dissolution of tight junctions. This leads to intra-retinal fluid accumulation and a detrimental effect on visual acuity. Moreover, VEGF can also cause the release of inflammatory cytokines that further reinforce the cycle of inflammation and angiogenesis.

In some embodiments, treatments inhibiting VEGF, PDGF, and/or the receptors (in a combination therapy or in one molecule) using the binding proteins disclosed herein may offer improved options for patients with wet AMD, while reducing the number of injections, reducing the safety concerns associated with multiple injections, and reducing cost.

2. Diabetic Retinopathy

Diabetic retinopathy is the most common diabetic eye disease and a leading cause of blindness in American adults. It is caused by changes in the blood vessels of the retina. In some people with diabetic retinopathy, blood vessels may swell and leak fluid. In other people, abnormal new blood vessels grow on the surface of the retina. The retina is the light-sensitive tissue at the back of the eye. A healthy retina is necessary for good vision.

Diabetic retinopathy has four stages: (1) Mild Nonproliferative Retinopathy. At this earliest stage, microaneurysms occur. They are small areas of balloon-like swelling in the retina's tiny blood vessels. (2) Moderate Nonproliferative Retinopathy. As the disease progresses, some blood vessels that nourish the retina are blocked. (3) Severe Nonproliferative Retinopathy. Many more blood vessels are blocked, depriving several areas of the retina with their blood supply. These areas of the retina send signals to the body to grow new blood vessels for nourishment. (4) Proliferative Retinopathy. At this advanced stage, the signals sent by the retina for nourishment trigger the growth of new blood vessels. This condition is called proliferative retinopathy. These new blood vessels are abnormal and fragile. They grow along the retina and along the surface of the clear, vitreous gel that fills the inside of the eye. By themselves, these blood vessels do not cause symptoms or vision loss. However, they have thin, fragile walls. If they leak blood, severe vision loss and even blindness can result.

Blood vessels damaged from diabetic retinopathy can cause vision loss in two ways: (1) Fragile, abnormal blood vessels can develop and leak blood into the center of the eye, blurring vision. This is proliferative retinopathy and is the fourth and most advanced stage of the disease. (2) Fluid can leak into the center of the macula, the part of the eye where sharp, straight-ahead vision occurs. The fluid makes the macula swell, blurring vision. This condition is called macular edema. It can occur at any stage of diabetic retinopathy, although it is more likely to occur as the disease progresses. About half of the people with proliferative retinopathy also have macular edema.

In some embodiments, the binding proteins disclosed herein may be used to inhibit VEGF, PDGF, and/or the receptors (in a combination therapy or in one molecule) to treat diabetic retinopathy.

In various embodiments, other diseases may be treated using the binding proteins disclosed herein, including but not limited to other eye disorders, cancers, fibrosis, renal disease, pathologic angiogenesis, wound healing, bone formation, or other diseases associated with aberrant (e.g., elevated) PDGF and/or VEGF expression.

Pharmaceutical Compositions

In various embodiments, pharmaceutical compositions comprising one or more of the binding proteins disclosed herein, either alone or in combination with other prophylactic agents, therapeutic agents, and/or pharmaceutically acceptable carriers, are provided. The pharmaceutical compositions comprising binding proteins provided herein are for use in, but not limited to, diagnosing, detecting, or monitoring a disorder, in preventing, treating, managing, or ameliorating a disorder or one or more symptoms thereof, and/or in research. The formulation of pharmaceutical compositions, either alone or in combination with prophylactic agents, therapeutic agents, and/or pharmaceutically acceptable carriers, are known to one skilled in the art (see, e.g., U.S. Patent Appl. No. 20090311253 and U.S. Pat. No. 7,612,181).

Methods of administering a pharmaceutical composition or a prophylactic or therapeutic agent provided herein include, but are not limited to, parenteral administration (e.g., intradermal, intramuscular, intraperitoneal, intravitreous, intravenous and subcutaneous), epidural administration, intratumoral administration, mucosal administration (e.g., intranasal and oral routes) and pulmonary administration (e.g., aerosolized compounds administered with an inhaler or nebulizer). In an embodiment, the methods of administering a pharmaceutical composition or a prophylactic or therapeutic agent provided herein include topical eye drops, gels, or creams. The formulation of pharmaceutical compositions for specific routes of administration, and the materials and techniques necessary for the various methods of administration are available and known to one skilled in the art (U.S. Patent Appl. No. 20090311253 and U.S. Pat. No. 7,612,181).

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. The term "dosage unit form" refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms provided herein are dictated by and directly dependent on (a) the unique characteristics of the active compound and the particular therapeutic or prophylactic effect to be achieved, and (b) the limitations inherent in the art of compounding such an active compound for the treatment of sensitivity in individuals. An exemplary, non-limiting range for a therapeutically or prophylactically effective amount of a binding protein provided herein is 0.1-20 mg/kg, for example, 1-10 mg/kg. It is to be noted that dosage values may vary with the type and severity of the condition to be alleviated. It is to be further understood that for any particular subject, specific dosage regimens may be adjusted over time according to the individual need and the professional judgment of the person administering or supervising the administration of the compositions, and that dosage ranges set forth herein are exemplary only and are not intended to limit the scope or practice of the claimed composition.

Combination Therapy

In various embodiments, a binding protein provided herein may also be administered with one or more additional therapeutic agents useful in the treatment of various diseases, the additional agent being selected by the skilled artisan for its intended purpose. For example, the additional agent can be a therapeutic agent art-recognized as being useful to treat the disease or condition being treated by the antibody provided herein, such as AMD. The combination can also include more than one additional agent, e.g., two or three additional agents.

Combination therapy agents include, but are not limited to imaging agents, cytotoxic agents, angiogenesis inhibitors, kinase inhibitors, tyrosine kinase inhibitors, tyrosine kinase receptor inhibitors, co-stimulation molecule blockers, adhesion molecule blockers, anti-cytokine antibodies or functional fragments thereof, methotrexate, cyclosporin, rapamycin, FK506, detectable labels or reporters, TNF antagonists, antirheumatics, muscle relaxants, narcotics, non-steroid anti-inflammatory drugs (NSAIDs), analgesics, anesthetics, local anesthetics, sedatives, a hyaluronidase enzyme, neuromuscular blockers, antimicrobials, antipsoriatics, corticosteriods, anabolic steroids, erythropoietin, immunizations, immunoglobulins, immunosuppressives, growth hormones, hormone replacement drugs, radiopharmaceuticals, antidepressants, antipsychotics, stimulants, asthma medications, beta agonists, inhaled steroids, epinephrine or analogs, cytokines, or cytokine antagonists.

Diagnostics

The disclosure herein also provides, in various embodiments, diagnostic applications including, but not limited to, diagnostic assay methods, diagnostic kits containing one or more binding proteins, and adaptation of the methods and kits for use in automated and/or semi-automated systems. The methods, kits, and adaptations provided may be employed in the detection, monitoring, and/or treatment of a disease or disorder in an individual. This is further elucidated below.

The present disclosure also provides a method for determining the presence, amount or concentration of an analyte, or fragment thereof, in a test sample using at least one binding protein as described herein. Any suitable assay as is known in the art can be used in the method. Examples include, but are not limited to, immunoassays and/or methods employing mass spectrometry.

Immunoassays provided by the present disclosure may include sandwich immunoassays, radioimmunoassay (RIA), enzyme immunoassay (EIA), enzyme-linked immunosorbent assay (ELISA), competitive-inhibition immunoassays, fluorescence polarization immunoassay (FPIA), enzyme multiplied immunoassay technique (EMIT), bioluminescence resonance energy transfer (BRET), and homogenous chemiluminescent assays, among others.

A chemiluminescent microparticle immunoassay, in particular one employing the ARCHITECT® automated analyzer (Abbott Laboratories, Abbott Park, Ill.), is an example of an immunoassay.

Methods employing mass spectrometry are provided by the present disclosure and include, but are not limited to MALDI (matrix-assisted laser desorption/ionization) or by SELDI (surface-enhanced laser desorption/ionization).

Methods for collecting, handling, processing, and analyzing biological test samples using immunoassays and mass spectrometry would be well-known to one skilled in the art, are provided for in the practice of the present disclosure (see, e.g., U.S. Pat. No. 7,612,181).

Kits

In various embodiments, a kit for assaying a test sample for the presence, amount or concentration of an analyte, or fragment thereof, in a test sample is also provided. The kit comprises at least one component for assaying the test sample for the analyte, or fragment thereof, and instructions for assaying the test sample for the analyte, or fragment thereof. The at least one component for assaying the test sample for the analyte, or fragment thereof, can include a composition comprising a binding protein, as disclosed herein, and/or an anti-analyte binding protein (or a fragment, a variant, or a fragment of a variant thereof), which is optionally immobilized on a solid phase.

Optionally, the kit may comprise a calibrator or control, which may comprise isolated or purified analyte. The kit can comprise at least one component for assaying the test sample for an analyte by immunoassay and/or mass spectrometry. The kit components, including the analyte, binding protein, and/or anti-analyte binding protein, or fragments thereof, may be optionally labeled using any art-known detectable label. The materials and methods for the creation provided for in the practice of the present disclosure would be known to one skilled in the art (see, e.g., U.S. Pat. No. 7,612,181).

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle), as described, for example, in U.S. Pat. Nos. 5,089,424 and 5,006,309, and as commercially marketed, for example, by Abbott Laboratories (Abbott Park, Ill.) as ARCHITECT®.

Other platforms available from Abbott Laboratories include, but are not limited to, AxSYM®, IMx® (see, for example, U.S. Pat. No. 5,294,404, PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STATED, Abbott Laboratories) electrochemical immunoassay system that performs sandwich immunoassays Immunosensors and their methods of manufacture and operation in single-use test devices are described, for example in, U.S. Pat. Nos. 5,063,081, 7,419,821, 7,682,833, 7,723,099, and 9,035,027; and U.S. Publication No. 20040018577.

Sequences

Table 1 discloses amino acid and nucleotide sequences encoding VEGF-A from different human isoforms and different species. Table 2 discloses amino acid and nucleotide sequences encoding PDGF-BB from different human isoforms and different species. Table 3 discloses human IgG heavy chain and light chain constant domains, including sequences with the indicated amino acid modifications relative to the wild-type sequence. In various embodiments, the constant domains listed in Table 3 can be used with any of the binding proteins disclosed herein. The variable domains of the binding proteins disclosed herein may be attached to constant regions of any immunoglobulin species, isotypes, or mutants. Exemplary modifications in constant domain mutants include those with amino acid mutations intended to increase or reduce constant domain interactions with Fc-gamma receptors, C1q and FcRn, and/or mutations intended to modulate protein stability or valency (full-length and half molecule, heterodimer molecule, etc.). Tables 4 and 5 disclose exemplary heavy and light chain acceptor framework sequences that can be used with any of the CDR sets disclosed herein (i.e., heavy chain acceptor sequences paired with any of the heavy chain CDRs 1-3 disclosed herein, and/or light chain acceptor sequences paired with any of the light chain CDRs 1-3 disclosed herein) to form functional binding sites for PDGF, VEGF, and/or their cognate receptors.

TABLE 1

| Amino Acid and Nucleotide Sequences for VEGF-A | | |
|---|---|---|
| Kind of Sequence | Sequence Identifier | Sequence 12345678901234567890123456789 0 |
| Human VEGF-A 165 Amino Acid Sequence | SEQ ID NO: 253 | APMAEGGGQNHHEVVKFMDVYQRSYCHPIE TLVDIFQEYPDEIEYIFKPSCVPLMRCGGC CNDEGLECVPTEESNITMQIMRIKPHQGQH IGEMSFLQHNKCECRPKKDRARQENPCGPC SERRKHLFVQDPQTCKCSCKNTDSRCKARQ LELNERTCRCDKPRR |

TABLE 1-continued

Amino Acid and Nucleotide Sequences for VEGF-A

| Kind of Sequence | Sequence Identifier | Sequence<br>12345678901234567890123456789 0 |
|---|---|---|
| Human VEGF-A 121 Amino Acid Sequence | SEQ ID NO: 254 | APMAEGGGQNHHEVVKFMDVYQRSYCHPIE<br>TLVDIFQEYPDEIEYIFKPSCVPLMRCGGC<br>CNDEGLECVPTEESNITMQIMRIKPHQGQH<br>IGEMSFLQHNKCECRPKKDRARQEKCDKPR<br>R |
| Human VEGF-A 110 Amino Acid Sequence | SEQ ID NO: 255 | APMAEGGGQNHHEVVKFMDVYQRSYCHPIE<br>TLVDIFQEYPDEIEYIFKPSCVPLMRCGGC<br>CNDEGLECVPTEESNITMQIMRIKPHQGQH<br>IGEMSFLQHNKCECRCDKPRR |
| Cynomolgus monkey VEGF-A 165 Amino Acid Sequence | SEQ ID NO: 256 | APMAEGGGQNHHEVVKFMDVYQRSYCHPIE<br>TLVDIFQEYPDEIEYIFKPSCVPLMRCGGC<br>CNDEGLECVPTEESNITMQIMRIKPHQGQH<br>IGEMSFLQHNKCECRPKKDRARQENPCGPC<br>SERRKHLFVQDPQTCKCSCKNTDSRCKARQ<br>LELNERTCRCDKPRR |
| Mouse VEGF-A 164 Amino Acid Sequence | SEQ ID NO: 257 | APTTEGEQKSHEVIKFMDVYQRSYCRPIET<br>LVDIFQEYPDEIEYIFKPSCVPLMRCAGCC<br>NDEALECVPTSESNITMQIMRIKPHQSQHI<br>ERMSFLQHSRCECRPKKDRTKPENHCEPCS<br>ERRKHLFVQDPQTCKCSCKNTDSRCKARQL<br>ELNERTCRCDKPRR |
| Rat VEGF-A 164 Amino Acid Sequence | SEQ ID NO: 258 | APTTEGEQKAHEVVKFMDVYQRSYCRPIET<br>LVDIFQEYPDEIEYIFKPSCVPLMRCAGCC<br>NDEALECVPTSESNVTMQIMRIKPHQSQHI<br>GEMSFLQHSRCECRPKKDRTKPENHCEPCS<br>ERRKHLFVQDPQTCKCSCKNTDSRCKARQL<br>ELNERTCRCDKPRR |
| Rabbit VEGF-A Amino Acid Sequence | SEQ ID NO: 259 | MNFLLSWVHWSLALLLYLHHAKWSQAAPMA<br>EEGDNKPHEVVKFMEVYRRSYCQPIETLVD<br>IFQEYPDEIEYIFKPSCVPLVRCGGCCNDE<br>SLECVPTEEFNVTMQIMRIKPHQGQHIGEM<br>SFLQHNKCECRPKKDRARQENPCGPCSERR<br>KHLFVQDPQTCKCSCKNTDSRCKARQLELN<br>ERTCRCDKPRR |

TABLE 2

Amino Acid and Nucleotide Sequences for PDGF-BB

| Kind of Sequence | Sequence Identifier | Sequence<br>12345678901234567890123456789 0 |
|---|---|---|
| Human PDGF-BB Amino Acid Sequence | SEQ ID NO: 260 | SLGSLTIAEPAMIAECKTRTEVFEISRRLI<br>DRTNANFLVWPPCVEVQRCSGCCNNRNVQC<br>RPTQVQLRPVQVRKIEIVRKKPIFKKATVT<br>LEDHLACKCETVAAARPVT |
| Human PDGF-BB-RM (Retention Motif) Amino Acid Sequence | SEQ ID NO: 261 | MNRCWALFLSLCCYLRLVSAEGDPIPEELY<br>EMLSDHSIRSFDDLQRLLHGDPGEEDGAEL<br>DLNMTRSHSGGELESLARGRRSLGSLTIAE<br>PAMIAECKTRTEVFEISRRLIDRTNANFLV<br>WPPCVEVQRCSGCCNNRNVQCRPTQVQLRP<br>VQVRKIEIVRKKPIFKKATVTLEDHLACKC<br>ETVAAARPVTRSPGGSQEQRAKTPQTRVTI<br>RTVRVRRPPKGKHRKFKHTHDKTALKETLG<br>A |
| Cynomolgus monkey PDGF-BB Amino Acid Sequence | SEQ ID NO: 262 | SLGSLTVAEPAMIAECKTRTEVFEISRRLI<br>DRTNANFLVWPPCVEVQRCSGCCNNRNVQC<br>RPTQVQLRPVQVRKIEIVRKKPIFKKATVT<br>LEDHLACKCETVAAARPVT |
| Mouse PDGF-BB Amino Acid Sequence | SEQ ID NO: 263 | SLGSLAAAEPAVIAECKTRTEVFQISRNLI<br>DRTNANFLVWPPCVEVQRCSGCCNNRNVQC<br>RASQVQMRPVQVRKIEIVRKKPIFKKATVT<br>LEDHLACKCETIVTPRPVT |

TABLE 2-continued

Amino Acid and Nucleotide Sequences for PDGF-BB

| Kind of Sequence | Sequence Identifier | Sequence<br>12345678901234567890123456 7890 |
|---|---|---|
| Rat PDGF-BB Amino Acid Sequence | SEQ ID NO: 264 | SLGSLAAAEPAVIAECKTRTEVFQISRNLI<br>DRTNANFLVWPPCVEVQRCSGCCNNRNVQC<br>RASQVQMRPVQVRKIEIVRKKPVFKKATVT<br>LEDHLACKCETVVTPRPVT |
| Rabbit PDGF-BBA Amino Acid Sequence | SEQ ID NO: 265 | SLGSLAAAEPAVIAECKTRTEVFQISRNLI<br>DRTNANFLVWPPCVEVQRCSGCCNNRNVQC<br>RASQVQMRPVQVRKIEIVRKKPVFKKATVT<br>LEDHLACKCETVVTPRPVT |

TABLE 3

Amino Acid Sequences of Human IgG Heavy Chain and Light Chain Constant Domains

| Protein | Sequence Identifier | Sequence<br>12345678901234567890123456 7890 |
|---|---|---|
| Ig gamma-1 constant region | SEQ ID NO: 266 | ASTKGPSVFFLAPSSKSTSGGTAALGCLVK<br>DYFPEPVTVSWNSGALTSGVHTFPAVLQSS<br>GLYSLSSVVTVPSSSLGTQTYICNVNHKPS<br>NTKVDKKVEPKSCDKTHTCPPCPAPELLGG<br>PSVFLFPPKPKDTLMISRTPEVTCVVVDVS<br>HEDPEVKFNWYVDGVEVHNAKTKPREEQYN<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFFLYSKLTVDKSRW<br>QQGNVFSCSVMHEALHNHYTQKSLSLSPGK |
| Ig gamma-1 constant region L234A, L235A | SEQ ID NO: 267 | ASTKGPSVFFLAPSSKSTSGGTAALGCLVK<br>DYFPEPVTVSWNSGALTSGVHTFPAVLQSS<br>GLYSLSSVVTVPSSSLGTQTYICNVNHKPS<br>NTKVDKKVEPKSCDKTHTCPPCPAPEAAGG<br>PSVFLFPPKPKDTLMISRTPEVTCVVVDVS<br>HEDPEVKFNWYVDGVEVHNAKTKPREEQYN<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFFLYSKLTVDKSRW<br>QQGNVFSCSVMHEALHNHYTQKSLSLSPGK |
| Ig gamma-1 constant region L234A, L235A, H435A | SEQ ID NO: 268 | ASTKGPSVFFLAPSSKSTSGGTAALGCLVK<br>DYFPEPVTVSWNSGALTSGVHTFPAVLQSS<br>GLYSLSSVVTVPSSSLGTQTYICNVNHKPS<br>NTKVDKKVEPKSCDKTHTCPPCPAPEAAGG<br>PSVFLFPPKPKDTLMISRTPEVTCVVVDVS<br>HEDPEVKFNWYVDGVEVHNAKTKPREEQYN<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFFLYSKLTVDKSRW<br>QQGNVFSCSVMHEALHNAYTQKSLSLSPGK |
| Ig gamma-1 constant region L234A, L235A, H435R | SEQ ID NO: 269 | ASTKGPSVFFLAPSSKSTSGGTAALGCLVK<br>DYFPEPVTVSWNSGALTSGVHTFPAVLQSS<br>GLYSLSSVVTVPSSSLGTQTYICNVNHKPS<br>NTKVDKKVEPKSCDKTHTCPPCPAPEAAGG<br>PSVFLFPPKPKDTLMISRTPEVTCVVVDVS<br>HEDPEVKFNWYVDGVEVHNAKTKPREEQYN<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFFLYSKLTVDKSRW<br>QQGNVFSCSVMHEALHNRYTQKSLSLSPGK |
| Ig gamma-1 constant region C226A, C229A, N297A, F405R (Half body) | SEQ ID NO: 270 | ASTKGPSVFFLAPSSKSTSGGTAALGCLVK<br>DYFPEPVTVSWNSGALTSGVHTFPAVLQSS<br>GLYSLSSVVTVPSSSLGTQTYICNVNHKPS<br>NTKVDKKVEPKSCDKTHTAPPAPAPELLGG<br>PSVFLFPPKPKDTLMISRTPEVTCVVVDVS |

TABLE 3-continued

Amino Acid Sequences of Human IgG Heavy Chain and Light Chain Constant Domains

| Protein | Sequence Identifier | Sequence<br>123456789012345678901234567890 |
|---|---|---|
| | | HEDPEVKFNWYVDGVEVHNAKTKPREEQYA<br>STYRVVSVLTVLHQDWLNGKEYKCKVSNKA<br>LPAPIEKTISKAKGQPREPQVYTLPPSREE<br>MTKNQVSLTCLVKGFYPSDIAVEWESNGQP<br>ENNYKTTPPVLDSDGSFRLYSKLTVDKSRW<br>QQGNVFSCSVMHEALHNHYTQKSLSLSPGK |
| Ig Kappa constant region | SEQ ID NO: 271 | RTVAAPSVFIFPPSDEQLKSGTASVVCLLN<br>NFYPREAKVQWKVDNALQSGNSQESVTEQD<br>SKDSTYSLSSTLTLSKADYEKHKVYACEVT<br>HQGLSSPVTKSFNRGEC |
| Ig Lambda constant region | SEQ ID NO: 272 | GQPKAAPSVTLFPPSSEELQANKATLVCLI<br>SDFYPGAVTVAWKADSSPVKAGVETTTPSK<br>QSNNKYAASSYLSLTPEQWKSHRSYSCQVT<br>HEGSTVEKTVAPTECS |

TABLE 4

Amino Acid Sequences of Heavy Chain Acceptor Frameworks

| SEQ ID NO: | Protein region/<br>Closest<br>Germline Family | Amino Acid Sequence<br>123456789012345678901234567890112 |
|---|---|---|
| 273 | VH3-7 FR1 | EVQLVESGGGLVQPGGSLRLSCAASGFTFS |
| 274 | VH3-7 FR2 | WVRQAPGKGLEWVA |
| 275 | VH3-7 FR3 | RFTISRDNAKNSLYLQMNSLRAEDTAVYYCAR |
| 276 | JH4 FR4 | WGQGTLVTVSS |
| 277 | VH3 CONSENUSUS FR1 | EVQLVESGGGLVQPGGSLRLSCAASGFTFS |
| 278 | VH3 CONSENUSUS FR2 | WVRQAPGKGLEWVS |
| 279 | VH3 CONSENUSUS FR3 | RFTISRDNSKNTLYLQMNSLRAEDTAVYYCAR |
| 280 | JH4 FR4 | WGQGTLVTVSS |
| 281 | VH1-46 FR1 | QVQLVQSGAEVKKPGASVKVSCKASGYTFT |
| 282 | VH1-46 FR2 | WVRQAPGQGLEWMG |
| 283 | VH1-46 FR3 | RVTMTRDTSTSTVYMELSSLRSEDTAVYYCAR |
| 284 | JH4 FR4 | WGQGTLVTVSS |
| 285 | VH3-30 FR1 | QVQLVESGGGVVQPGRSLRLSCAASGFTFS |
| 286 | VH3-30 FR2 | WVRQAPGKGLEWVA |
| 287 | VH3-30 FR3 | RFTISRDNSKNTLYLQMNSLRAEDTAVYYCAR |
| 288 | JH3 FR4 | WGQGTMVTVSS |
| 289 | VH3 CONSENUSUS FR1 | EVQLVESGGGLVQPGGSLRLSCAASGFTFS |
| 290 | VH3 CONSENUSUS FR2 | WVRQAPGKGLEWVS |
| 291 | VH3 CONSENUSUS FR3 | RFTISRDNSKNTLYLQMNSLRAEDTAVYYCAR |
| 292 | JH3 FR4 | WGQGTMVTVSS |
| 293 | VH2-70/JH6 FR1 | EVTLRESGPALVKPTQTLTLTCTFSGFSLS |
| 294 | VH2-70/JH6 FR2 | WIRQPPGKALEWLA |
| 295 | VH2-70/JH6 FR3 | RLTISKDTSKNQVVLTMTNMDPVDTATYYCAR |

TABLE 4-continued

Amino Acid Sequences of Heavy Chain Acceptor Frameworks

| SEQ ID NO: | Protein region/ Closest Germline Family | Amino Acid Sequence 123456789012345678901234567890122 |
|---|---|---|
| 296 | VH2-70/JH6 FR4 | WGQGTTVTVSS |
| 297 | VH2-26/JH6 FR1 | EVTLKESGPVLVKPTETLTLTCTVSGFSLS |
| 298 | VH2-26/JH6 FR2 | WIRQPPGKALEWLA |
| 299 | VH2-26/JH6 FR3 | RLTISKDTSKSQVVLTMTNMDPVDTATYYCAR |
| 300 | VH2-26/JH6 FR4 | WGQGTTVTVSS |
| 301 | VH3-72/JH6 FR1 | EVQLVESGGGLVQPGGSLRLSCAASGFTFS |
| 302 | VH3-72/JH6 FR2 | WVRQAPGKGLEWVG |
| 303 | VH3-72/JH6 FR3 | RFTISRDDSKNSLYLQMNSLKTEDTAVYYCAR |
| 304 | VH3-72/JH6 FR4 | WGQGTTVTVSS |
| 305 | VH3-21/JH6 FR1 | EVQLVESGGGLVKPGGSLRLSCAASGFTFS |
| 306 | VH3-21/JH6 FR2 | WVRQAPGKGLEWVS |
| 307 | VH3-21/JH6 FR3 | RFTISRDNAKNSLYLQMNSLRAEDTAVYYCAR |
| 308 | VH3-21/JH6 FR4 | WGQGTTVTVSS |
| 309 | VH1-69/JH6 FR1 | EVQLVQSGAEVKKPGSSVKVSCKASGGTFS |
| 310 | VH1-69/JH6 FR2 | WVRQAPGQGLEWMG |
| 311 | VH1-69/JH6 FR3 | RVTITADKSTSTAYMELSSLRSEDTAVYYCAR |
| 312 | VH1-69/JH6 FR4 | WGQGTTVTVSS |
| 313 | VH1-18/JH6 FR1 | EVQLVQSGAEVKKPGASVKVSCKASGYTFT |
| 314 | VH1-18/JH6 FR2 | WVRQAPGQGLEWMG |
| 315 | VH1-18/JH6 FR3 | RVTMTTDTSTSTAYMELRSLRSDDTAVYYCAR |
| 316 | VH1-18/JH6 FR4 | WGQGTTVTVSS |
| 317 | IGHV4-59 FR1 | EVQLQESGPGLVKPSETLSLTCTVSGGSIS |
| 318 | IGHV4-59 FR2 | WIRQPPGKGLEWIG |
| 319 | IGHV4-59 FR3 | RVTISVDTSKNQFSLKLSSVTAADTAVYYCAR |
| 320 | IGHV4-59/JH FR4 | WGQGTLVTVSS |
| 321 | IGHV3-66 FW1 | EVQLVESGGGLVQPGGSLRLSCAVSGGSIS |
| 322 | IGHV3-66 FW2 | WIRQAPGKGLEWIG |
| 323 | IGHV3-66 FW3 | RVTISVDTSKNSFYLQMNSLRAEDTAVYYCAR |
| 324 | IGHV3-66/JH FW4 | WGQGTLVTVSS |
| 325 | IGHV4-59 FR1 | EVQLQESGPGLVKPGETLSLTCTVSGGSIS |
| 326 | IGHV4-59 FR2 | WIRQAPGKGLEWIG |
| 327 | IGHV4-59 FR3 | RVTISVDTSKNQFYLKLSSVRAEDTAVYYCAR |
| 328 | IGHV4-59/JH FR4 | WGQGTLVTVSS |
| 329 | IGHV5-51 FR1 | EVQLVQSGTEVKKPGESLKISCKVSGGSIS |
| 330 | IGHV5-51 FR2 | WIRQMPGKGLEWIG |
| 331 | IGHV5-51 FR3 | QVTISVDTSFNTFFLQWSSLKASDTAMYYCAR |
| 332 | IGHV5-51/JH FR4 | WGQGTMVTVSS |

TABLE 4-continued

Amino Acid Sequences of Heavy Chain Acceptor Frameworks

| SEQ ID NO: | Protein region/ Closest Germline Family | Amino Acid Sequence 1234567890123456789012345678901 2 |
|---|---|---|
| 333 | IGHV2-70 FR1 | EVTLRESGPALVKPTQTLTLTCTVSGGSIS |
| 334 | IGHV2-70 FR2 | WIRQPPGKGLEWIG |
| 335 | IGHV2-70 FR3 | RVTISVDTSKNQFVLTMTNMDPVDTATYYCAR |
| 336 | IGHV2-70/JH FR4 | WGQGTTVTVSS |
| 337 | IGHV3-15 FR1 | EVQLLESGGGLVKSGGSLRLSCAASGFTFR |
| 338 | IGHV3-15 FR2 | WVRQAPGKGLEWVA |
| 339 | IGHV3-15 FR3 | RFTISRDNSKNTLYLQLNSLRAEDTAVYYCAK |
| 340 | IGHV3-15/JH FR4 | WGQGTMVTVSS |
| 341 | IGHV3-43 FR1 | EVQLVESGGGVVQPGGSLRLSCAASGFTFG |
| 342 | IGHV3-43 FR2 | WVRQAPGKGLEWVA |
| 343 | IGHV3-43 FR3 | RFTISRDNSKNTLYLQLNSLRAEDTAVYYCAK |
| 344 | IGHV3-43/JH FR4 | WGQGTMVTVSS |

TABLE 5

Amino Acid Sequences of Light Chain Acceptor Frameworks

| SEQ ID NO: | Protein region/ Closest Germline Family | Sequence 1234567890123456789012345678901 2 |
|---|---|---|
| 345 | O2 FR1 | DIQMTQSPSSLSASVGDRVTITC |
| 346 | O2 FR2 | WYQQKPGKAPKLLIY |
| 347 | O2 FR3 | GVPSRFSGSGSGTDFTLTISSLQPEDFATYYC |
| 348 | JK2 FR4 | FGQGTKLEIK |
| 349 | L2 FR1 | EIVMTQSPATLSVSPGERATLSC |
| 350 | L2 FR2 | WYQQKPGQAPRLLIY |
| 351 | L2 FR3 | GIPARFSGSGSGTEFTLTISSLQSEDFAVYYC |
| 352 | JK2 FR4 | FGQGTKLEIK |
| 353 | B3/JK4 FR1 | DIVMTQSPDSLAVSLGERATINC |
| 354 | B3/JK4 FR2 | WYQQKPGQPPKLLIY |
| 355 | B3/JK4 FR3 | GVPDRFSGSGSGTDFTLTISSLQAEDVAVYYC |
| 356 | B3/JK4 FR4 | FGGGTKVEIKR |
| 357 | L2/JK4 FR1 | EIVMTQSPATLSVSPGERATLSC |
| 358 | L2/JK4 FR2 | WYQQKPGQAPRLLIY |
| 359 | L2/JK4 FR3 | GIPARFSGSGSGTEFTLTISSLQSEDFAVYYC |
| 360 | L2/JK4 FR4 | FGGGTKVEIKR |
| 361 | L15/JK4 FR1 | DIQMTQSPSSLSASVGDRVTITC |
| 362 | L15/JK4 FR2 | WYQQKPEKAPKSLIY |
| 363 | L15/JK4 FR3 | GVPSRFSGSGSGTDFTLTISSLQPEDFATYYC |
| 364 | L15/JK4 FR4 | FGGGTKVEIKR |
| 365 | L5/JK4 FR1 | DIQMTQSPSSVSASVGDRVTITC |
| 366 | L5/JK4 FR2 | WYQQKPGKAPKLLIY |
| 367 | L5/JK4 FR3 | GVPSRFSGSGSGTDFTLTISSLQPEDFATYYC |
| 368 | L5/JK4 FR4 | FGGGTKVEIKR |
| 369 | IGLV3-1 FR1 | SYELTQPPSVSVSPGQTASITC |
| 370 | IGLV3-1 FR2 | WYQQKPGQSPVLVIY |
| 371 | IGLV3-1 FR3 | GIPERFSGSNSGDTATLTISGTQPMDEADYYC |
| 372 | IGLV3-1/JL FR4 | FGYGTKVTVL |
| 373 | IGLV3-1 FR1 | SYELTQPPSVSVSPGQTASITC |
| 374 | IGLV3-1 FR2 | WYQQKPGQSPVLVIY |
| 375 | IGLV3-1 FR3 | GIPERFSGSNSGDTATLTISGTQPMDEADYYC |
| 376 | IGLV3-1/JL FR4 | GGGTKLTVLG |
| 377 | IGLV3-1 FR1 | YELTQPPSVSVSPGQTASITC |
| 378 | IGLV3-1 FR2 | WYQQKPGQSPVLVIY |
| 379 | IGLV3-1 FR3 | GIPERFSGSNSGDTATLTISGTQPMDEADYYC |
| 380 | IGLV3-1/JL FR4 | GGGTKLTVLG |

TABLE 5-continued

Amino Acid Sequences of Light Chain Acceptor Frameworks

| Protein region/ SEQ ID NO: | Closest Germline Family | Sequence 1234567890123456789012345678901 2 |
|---|---|---|
| 381 | IGLV3-1 FR1 | LYVLTQPPSVSVSPGQTASITC |
| 382 | IGLV3-1 FR2 | WYQQKPGQSPVLVIY |
| 383 | IGLV3-1 FR3 | GIPERFSGSNSGDTATLTISGTQTMDEADYLC |
| 384 | IGLV3-1/JL FR4 | FGGGTKVTVLG |
| 385 | IGKV6D-21 FR1 | EYVLTQSPDFQSVTPKEKVTITC |
| 386 | IGKV6D-21 FR2 | WYQQKPDQSPKLVIY |
| 387 | IGKV6D-21 FR3 | GVPSRFSGSNSGDDATLTINSLEAEDAATYYC |
| 388 | IGKV6D-21/JK FR4 | FGQGTKVEIKR |
| 389 | IGKV3D-15 FR1 | EYVLTQSPATLSVSPGERATLSC |
| 390 | IGKV3D-15 FR2 | WYQQKPGQSPRLVIY |
| 391 | IGKV3D-15 FR3 | DIPARFSGSNSGDEATLTISSLQSEDFAVYYC |
| 392 | IGKV3D-15/JK FR4 | FGQGTRLEIKR |
| 393 | IGKV4-1 FR1 | DYVLTQSPDSLAVSLGERATINC |
| 394 | IGKV4-1 FR2 | WYQQKPGQSPKLVIY |
| 395 | IGKV4-1 FR3 | GIPDRFSGSNSGDDATLTISSLQAEDVAVYYC |
| 396 | IGKV4-1/JK FR4 | FGGGTKVEIKR |
| 397 | IGLV3-1 FR1 | LPVLTQPPSVSVSPGQTASITC |
| 398 | IGLV3-1 FR2 | WYQQKPGQSPVLVIY |
| 399 | IGLV3-1 FR3 | GIPERFSGSNSGNTATLTISGTQTMDEADYLC |
| 400 | IGLV3-1/JL FR4 | FGGGTKVTVL |
| 401 | IGLV3-1 FR1 | SYELTQPPSVSVSPGQTASITC |
| 402 | IGLV3-1 FR2 | WYQQKPGQSPVLVIY |
| 403 | IGLV3-1 FR3 | GIPERFSGSNSGNTATLTISGTQTMDEADYLC |
| 404 | IGLV3-1/JL FR4 | FGGGTKLTVL |

TABLE A

Select Heavy Chain and Light Chain Variable Domain Sequences (CDRs in bold)

| SEQ ID NO | VD name | Sequence 1234567890123456789012345678901 2 |
|---|---|---|
| 1 | hBDI-9E8.4 VH (PDGF) | EVTLRESGPALVKPTQTLTLTCTFSGFSLSTYGMGVGWIRQPPGKALEW LANIWWDDDKYYNPSLKNRLTISKDTSKNQVVLTMTNMDPVDTATYYCA RIESIGTTYSFDYWGQGTMVTSS |
| 2 | hBDI-9E8.4 VL (PDGF) | EFVLTQSPGTLSLSPGERATLSCERSSGDIGDSYVSWYQQKPGQAPRLV IYADDQRPSGIPDRFSGSGSGTDFTLTISRLEPEDFAVYYCQSYDINID IVFGGGTKVEIK |
| 3 | hBDI-5H1.9 VH (PDGF) | EVTLRESGPALVKPTQTLTLTCTFSGFSLSTFGMGVGWIRQPPGKALEW LANIWWDDDKYYNPSLKNRLTISKDTSKNQAVLTITNMDPVDTATYYCA RISTGISSYYVMDAWGQGTTVTSS |
| 4 | hBDI-5H1.9 VL (PDGF) | DFVLTQSPDSLAVSLGERATINCERSSGDIGDTYVSWYQQKPGQPPKNV IYGNDQRPSGVPDRFSGSGSGNSATLTISSLQAEDVAVYFCQSYDSDID IVFGGGTKVEIK |
| 5 | hBDI-9E8.12 VH (PDGF) | EVQLVESGGGLVQPGGSLRLSCAFSGFSLSTYGMGVGWIRQAPGKGLEW LANIWWDDDKYYNPSLKNRLTISKDTSKNQAYLQINSLRAEDTAVYYCA RIESIGTTYSFDYWGQGTLVTSS |
| 6 | hBDI-9E8.12 VL (PDGF) | DFQLTQSPSSLSASVGDRVTITCERSSGDIGDSYVSWYQQKPGKAPKNV IYADDQRPSGVPSRFSGSGSGNSASLTISSLQPEDFATYYCQSYDINID IVFGQGTKVEIK |
| 7 | hBDI-9E8.9 VH (PDGF) | EVTLRESGPALVKPTQTLTLTCTFSGFSLSTYGMGVGWIRQPPGKALEW LANIWWDDDKYYNPSLKNRLTISKDTSKNQAVLTITNMDPVDTATYYCA RIESIGTTYSFDYWGQGTTVTSS |
| 8 | hBDI-9E8.9 VL (PDGF) | DFVLTQSPDSLAVSLGERATINCERSSGDIGDSYVSWYQQKPGQPPKNV IYADDQRPSGVPDRFSGSGSGNSASLTISSLQAEDVAVYFCQSYDINID IVFGGGTKVEIK |
| 9 | hBDI-9E8.12 VH (PDGF) | EVQLVESGGGLVQPGGSLRLSCAFSGFSLSTYGMGVGWIRQAPGKGLEW LANIWWDDDKYYNPSLKNRLTISKDTSKNQAYLQINSLRAEDTAVYYCA RIESIGTTYSFDYWGQGTLVTSS |

TABLE A-continued

Select Heavy Chain and Light Chain Variable Domain Sequences
(CDRs in bold)

| SEQ ID NO | VD name | Sequence<br>12345678901234567890123456789012 |
|---|---|---|
| 10 | hBDI-9E8.12 VL (PDGF) | DFQLTQSPSSLSASVGDRVTITCERSSGDIGDSYVSWYQQKPGKAPKNV<br>IYADDQRPSGVPSRFSGSGSGNSASLTISSLQPEDFATYYCQSYDINID<br>IVFGQGTKVEIK |
| 11 | hBDI-9E8.4E VH (PDGF) | EVTLRESGPALVKPTQTLTLTCTFSGFSLSTYGMGVGWIRQPPGKALEW<br>LANIWWDDDKYYNPSLKNRLTISKDTSKNQVVLTMTNMDPVDTATYYCA<br>RIESIGTTYSFDYWGQGTMVTVSS |
| 12 | hBDI-9E8.4E VL (PDGF) | EFVLTQSPGTLSLSPGERATLSCERSSGDIGESYVSWYQQKPGQAPRLV<br>IYADDQRPSGIPDRFSGSGSGTDFTLTISRLEPEDFAVYYCQSYDINID<br>IVFGGGTKVEIK |
| 13 | hBFU-3E2.1 VH (PDGF) | EVQLVQSGAEVKKPGSSVKVSCKASGYTFTESYMYWVKQAPGQGLELIG<br>RIDPEDGSTDYVEKFKNKATLTADKSTSTAYMELSSLRSEDTAVYFCAR<br>FGARSYFYPMDAWGQGTTVTVSS |
| 14 | hBFU-3E2.1 VL (PDGF) | ETVLTQSPATLSLSPGERATLSCRASESVSTLMHWYQQKPGQPRLLIY<br>GASNLESGVPARFSGSGSGTDFTLTISSLEPEDFAVYFCQQSWNDPWTF<br>GGGTKVEIK |
| 15 | CL-33675 VH (PDGF) | EVTLRESGPALVKPTQTLTLTCTFSGFSLSTYGMGVGWIRQPPGKALEW<br>LANIWWDDDKYYNPSLKNRLTISKDTSKNQVVLTMTNMDPVDTATYYCA<br>RIESSGPKYSFDYWGQGTMVTVSS |
| 16 | CL-33675 VL (PDGF) | EIVLTQSPGTLSLSPGERATLSCRASSGSIWYSFVSWYQQKPGQAPRLL<br>IYADDQRASGIPDRFSGSGSGTDFTLTISRLEPEDFAVYYCQSYGINID<br>VVFGGGTKVEIK |
| 17 | hBDB-4G8.3 VH (VEGF) | EVQLVQSGSELKKPGASVKVSCKASGYTFTNYGMYWVRQAPGQGLEWMG<br>WINTETGKPTYADDFKGRFVFSLDTSVSTAYLQISSLKAEDTAVYYCAR<br>TNYYRSYIFYFDYWGQGTMVTVSS |
| 18 | hBDB-4G8.3 VL (VEGF) | DTVLTQSPATLSLSPGERATLSCRASESVSTHMHWYQQKPGQAPRLLIY<br>GASNLESGVPARFSGSGSGTDFTLTISSLEPEDFAVYFCQQSWNDPFTF<br>GQGTKLEIK |
| 19 | hBDB-4G8.13 VH (VEGF) | EIQLVQSGTEVKKPGESLKISCKASGYTFTNYGMYWVKQMPGKGLEYMG<br>WINTETGKPTYADDFKGRFTFSLDKSFNTAFLQWSSLKASDTAMYFCAR<br>TNYYRSYIFYFDYWGQGTMVTVSS |
| 20 | hBDB-4G8.13 VL (VEGF) | ETVLTQSPATLSVSPGERATLSCRASESVSTHMHWYQQKPGQAPRLLIY<br>GASNLESGVPARFSGSGSGTDFTLTISSLQSEDFAVYFCQQSWNDPFTF<br>GQGTRLEIK |
| 21 | hBDB-4G8.14 VH (VEGF) | EIQLVQSGGGVVQPGGSLRLSCAASGYTFTNYGMYWVKQAPGKGLEYMG<br>WINTETGKPTYADDFKGRFTFSLDTSKSTAYLQLNSLRAEDTAVYFCAR<br>TNYYRSYIFYFDYWGQGTLVTVSS |
| 22 | hBDB-4G8.14 VL (VEGF) | DTVLTQSPSTLSASPGERATISCRASESVSTHMHWYQQKPGQAPKLLIY<br>GASNLESGVPSRFSGSRSGTDFTLTISSLQPEDFAVYFCQQSWNDPFTF<br>GQGTKVEIK |
| 23 | hBDB-4G8.15 VH (VEGF) | EVQLVESGGGLVQPGGSLRLSCAASGYTFTNYGMYWVKQAPGKGLEYMG<br>WINTETGKPTYADDFKGRFTFSLDTSKSTAYLQMNSLRAEDTAVYFCAR<br>TNYYRSYIFYFDYWGQGTLVTVSS |
| 24 | hBDB-4G8.15 VL (VEGF) | DTQLTQSPSSLSASVGDRVTISCRASESVSTHMHWYQQKPGKAPKLLIY<br>GASNLESGVPSRFSGSGSGTDFTLTISSLQPEDFATYFCQQSWNDPFTF<br>GQGTKVEIK |
| 25 | hBEW-9A8.12 VH (VEGF) | EVQLVQSGAEVKKPGASVKVSCKASGYTFTNYGMYWVRQAPGQGLEWMG<br>WINTETGKPIYADDFKGRVTMTTDTSTSTAYMELRSLRSDDTAVYYCAR<br>VDYDGSFWFAYWGQGTLVTVSS |
| 26 | hBEW-9A8.12 VL (VEGF) | DTQLTQSPSSLSASVGDRVTITCRASESVSTVIHWYQQKPGKQPKLLIH<br>GASNLESGVPSRFSGSGSGTDFTLTISSLQPEDFATYFCQQHWNDPPTF<br>GQGTKLEIK |
| 27 | hBDB-4G8.2 VH (VEGF) | EVQLVQSGSELKKPGASVKVSCKASGYTFTNYGMYWVRQAPGQGLEWMG<br>WINTETGKPTYADDFKGRFVFSLDTSVSTAYLQISSLKAEDTAVYYCAR<br>TNYYRSYIFYFDYWGQGTMVTVSS |

TABLE A-continued

Select Heavy Chain and Light Chain Variable Domain Sequences
(CDRs in bold)

| SEQ ID NO | VD name | Sequence<br>123456789012345678901234567890123456789012 |
|---|---|---|
| 28 | hBDB-4G8.2 VL (VEGF) | ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIK |
| 29 | hBDB-4G8.4 VH (VEGF) | EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSS |
| 30 | hBDB-4G8.4 VL (VEGF) | AIQLTQSPSSLSASVGDRVTITCRASESVSTHMHWYQQKPGKAPKLLIYGASNLESGVPSRFSGSGSGTDFTLTISSLQPEDFATYYCQQSWNDPFTFGQGTKLEIK |
| 31 | hBDB-4G8.5 VH (VEGF) | EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSS |
| 32 | hBDB-4G8.5 VL (VEGF) | ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIK |
| 33 | hBDB-4G8.12 VH (VEGF) | EIQLVQSGAEVKKPGASVKVSCKASGYTFTNYGMYWVRQAPGQGLEYMGWINTETGKPTYADDFKGRFTFTLDTSTSTAYMELRSLRSDDTAVYFCARTNYYYRSYIFYFDYWGQGTMVTVSS |
| 34 | hBDB-4G8.12 VL (VEGF) | DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| 35 | hBEW-9E10.1 VH (VEGF) | EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSS |
| 36 | hBEW-9E10.1 VL (VEGF) | DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIK |
| 37 | hBEW-9E10.6 VH (VEGF) | EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSS |
| 38 | hBEW-9E10.6 VL (VEGF) | DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIK |
| 39 | hBEW-1B10.1 VH (VEGF) | EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSS |
| 40 | hBEW-1B10.1 VL (VEGF) | DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIK |
| 41 | hBEW-1E3.4 VH (VEGF) | EIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSS |
| 42 | hBEW-1E3.4 VL (VEGF) | ATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIK |
| 43 | CL-34565 VH (VEGF) | EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSS |
| 44 | CL-34565 VL (VEGF) | EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIK |
| 211 | hBDI-5H1.12 VH (PDGF) | EVQLVESGGGLVQPGGSLRLSCAFSGFSLSTFGMGVGWIRQAPGKGLEWLANIWWDDDKYYNPSLKNRLTISKDTSKNQAYLQINSLRAEDTAVYYCARISTGISSYYVMDAWGQGTLVTVSS |

TABLE A-continued

Select Heavy Chain and Light Chain Variable Domain Sequences
(CDRs in bold)

| SEQ ID NO | VD name | Sequence<br>123456789012345678901234567890123456789012 |
|---|---|---|
| 212 | hBDI-5H1.12 VL (PDGF) | DFQLTQSPSSLSASVGDRVTITCERSSGDIGDTYVSWYQQKPGKAPKNV IYGNDQRPSGVPSRFSGSGSGNSATLTISSLQPEDFATYFCQSYDSDID IVFGQGTKVEIK |

It will be readily apparent to those skilled in the art that other suitable modifications and adaptations of the methods described herein are obvious and may be made using suitable equivalents without departing from the scope of the embodiments disclosed herein. Having now described certain embodiments in detail, the same will be more clearly understood by reference to the following examples, which are included for purposes of illustration only and are not intended to be limiting.

EXAMPLES

Example 1: In Vitro Assays Used to Determine the Functional Activity of Anti-VEGF-A Antibodies, Anti-PDGF-BB Antibodies, Anti-VEGFR Antibodies, Anti-PDGFR-B Antibodies, and DVD-Ig Proteins Example 1.1: Affinity Determination Using BIACORE® Surface Plasmon Resonance Technology for Antigen Binding The BIACORE® surface plasmon resonance assay (Biacore, Inc., Piscataway, N.J.) determines the affinity of antibodies with kinetic measurements of on-rate and off-rate constants. Binding of anti-VEGF-A antibodies, anti-PDGF-BB antibodies, anti-VEGFR antibodies, anti-PDGFR-B antibodies, or anti-VEGF-A/anti-PDGF-BB DVD-Ig molecules, to a purified recombinant VEGF-A, PDGF-BB, VEGFR extracellular domain (ECD), PDGFR-B ECD or their Fc fusion proteins was determined by surface plasmon resonance-based measurements with a Biacore® instrument (either a Biacore 2000, Biacore 3000, or Biacore T100; GE Healthcare, Piscataway, N.J.) using running buffer HBS-EPB (10 mM HEPES [pH 7.4], 150 mM NaCl, 3 mM EDTA, 0.1 mg/ml BSA and 0.005% surfactant P20) at 25° C. For example, approximately 9000 RU of goat anti-human Fc specific polyclonal antibody (Thermo Fisher Scientific Inc., Rockford, Ill.) diluted in 10 mM sodium acetate (pH 4.5) is directly immobilized across a CM5 research grade biosensor chip using a standard amine coupling kit according to manufacturer's instructions and procedures at 25 µg/ml. Unreacted moieties on the biosensor surface were blocked with ethanolamine. For kinetic analysis, rate equations derived from the 1:1 Langmuir binding model were fitted simultaneously to multiple antigen injections (using global fit analysis) with the use of Scrubber 2 (BioLogic Software), Biacore Biaevaluation 4.0.1 software or Biacore T100 Evaluation software. Purified antibodies or DVD-Ig molecules were diluted in running buffer for capture across goat anti-human Fc reaction surfaces. Antibodies or DVD-Ig molecules to be captured as a ligand (1 µg/ml) were injected over reaction matrices at a flow rate of 10 µl/minute. During the assay, all measurements were referenced against the capture surface alone (i.e., with no captured antibody or DVD-Ig molecule). The association and dissociation rate constants, $K_{on}$ ($M^{-1}$ $s^{-1}$) and $K_{off}$ ($s^{-1}$) were determined under a continuous flow rate of 80 µl/minute. Rate constants were derived by making kinetic binding measurements at different antigen concentrations ranging from 1.23-900 nM, as a 3-fold dilution series, and included buffer-only injections (to be used for double referencing). The equilibrium dissociation constant $K_D$ (M) of the reaction between antibodies and the target antigen was then calculated from the kinetic rate constants by the following formula: $K_D=K_{off}/K_{on}$. Binding was recorded as a function of time and kinetic rate constants were calculated. In this assay, on-rates as fast as $10^6 M^{-1} s^{-1}$ and off-rates as slow as $10^{-6}$ $s^{-1}$ could be measured.

In some experiments, the conditions below were used for affinity determination:

Chip surface: CM5 chip with goat anti human Fc IgG (5000 RU).

Reference: Goat IgG (capture 5000 RU).

Running buffer: HBS-EP, 0.1 mg/ml BSA

DVD-Ig or mAbs were captured at 1 µg/ml, at 70-200 RU.

Recombinant ECD proteins were serially diluted 1:5 at 0.016-50 nM.

Association time was 5 min and dissociation time was observed for 10 and 30 min.

Flow rate was 50 ul/min.

Surface regeneration: two 30s pulses of 10 mM Glycine, pH 1.5, at 50 µl/min.

Example 1.2: Surface Resonance FcγRIIa, FcγRIIb, FcγRIIIa, and FcRn Binding Assay The binding of VEGF/PDGF DVD-Ig molecules to recombinant FcγRs captured via 6×His-tag (SEQ ID NO: 405) was assessed using a Biacore T200 (GE Healthcare) instrument. A CM5 chip (GE Healthcare, Pittsburgh, Pa.) with mouse anti-6×His antibodies ("6×His" disclosed as SEQ ID NO: 405) that were directly immobilized on the chip via amine coupling according to the GE Healthcare protocol to the density of 10000RU (all flow cells) was used for experiments. Human FcγRs were captured on flow cells 2, 3 and 4. Flow cell 1 was used as a reference surface. HBS-EP+ was used as the running buffer. Anti VEGF/PDGF DVD-Igs were injected over all the flow cells at a flow rate of 50 µL/minute for 1-2 minutes at concentrations of 31.25; 62.5, 125, 250, 500, 1000, 2000 and 4000 nM, followed by 1-3 minutes of dissociation. The chip surfaces were regenerated with an injection of 10 mM glycine pH 1.5 at a flow rate of 100 µL/minute over all four flow cells after each cycle.

For FcRn binding analysis, VEGF/PDGF DVD-Igs were directly immobilized on a CM5 chip by amine coupling according to the manufacturer's (GE Healthcare) protocol to a density of approximately 750 RU. Flow cell 1, where blank immobilization was performed, did not contain DVD-Igs and was used as a reference surface. Human, cynomolgus, mouse, rat and rabbit recombinant FcRns were injected over all the flow cells at a flow rate of 50 μL/minute for 1 minute at a concentrations range of from 2.7 to 6000 nM (three fold serial dilution), followed by a 2 minute dissociation time. The surfaces were regenerated with an injection of 10 mM HCl at 100 μL/minute for 2 seconds followed by an injection of HBS-EP+, pH 7.4, at a flow rate of 50 μL/minute for 30 seconds over all four flow cells. Samples were prepared and run in two running buffer systems, pH 6.0 MES-EP+, and pH 7.4 HBS-EP-EP+. Recombinant human FcγRIIIa V158 and rat and mouse FcRn data were fitted to 1:1 kinetic model. Recombinant human FcγRIIa R131 and FcγRIIa H131, FcγRIIIa F158, and recombinant human, cynomolgus and rabbit FcRn binding data were fitted to a steady state affinity model. Biacore T200 Evaluation Software version 2.0 was used to fit all the data.

Example 1.3: VEGF-A Binding Activity Determined by Capture ELISA

To identify molecules that could bind hVEGF$_{165}$, a direct binding ELISA was performed. 96-well high binding neutravidin plates (Thermo Scientific cat#15507) were coated with 0.25 μg/mL/6.51E-9 M biotinylated recombinant human VEGF$_{165}$ (AP PR-1361002, 50 μL/well in D-PBS), and shaken for 1.5 hours at 25° C. During the coating step, supernatant, antibodies, benchmark compounds or DVD-Ig were diluted in 10% Superblock (Thermo Scientific, cat#37535) and an eight point titration of each sample molecule was performed. Plates were then washed four times with wash buffer (TBS, 0.05% Tween-20). The sample molecule titration was added to the coated plate at 50 μL in duplicate and incubated for one hour at 25° C. with shaking. Following incubation, plates were washed four times with wash buffer. The appropriate anti-species-IgG HRP conjugate was diluted in assay diluent (10% Superblock containing 0.05% surfactamps) and added to plates (50 μL) for forty-five minutes at 25° C. with shaking. Plates were washed four times with wash buffer and developed with the addition of Enhanced K-blue TMB substrate (Neogen, Lexington, Ky. cat#308177). The reaction was stopped with 2N sulfuric acid (VWR, Radnor, Pa. cat#BDH3500-1) and the absorbance was read at 450 nm-570 nm. An increase in optical density indicates the binding of the test molecule to biotinylated recombinant human VEGF$_{165}$. Data was analyzed using Softmax Pro 4.8 software and IC$_{50}$ values calculated using a sigmoidal dose response (variable slope) fit in GraphPad Prism 5.

Example 1.4: VEGF-A Blocking Activity Determined by Inhibition of VEGF-R2 Interaction with Human VEGF$_{165}$ To identify molecules that could block the binding of hVEGF$_{165}$ to the hVEGF-R2 (KDR/Flk-1) receptor, a competition ELISA was performed. 96-well Costar high binding plates (#3369) were coated with 0.5 μg/mL/2.27E-9 M recombinant human VEGF-R2-Fc (R&D Systems cat#357-KD), 50 μL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatant, antibodies, benchmark compounds or DVD-Ig were diluted in 1% Blocker BSA (Thermo Scientific cat#37525) and an eight point titration of each sample molecule was performed. The biotinylated human VEGF$_{165}$ (AP, PR-1361002) was diluted in 1% Blocker BSA at 35 ng/mL. The sample molecule titration was added to the biotinylated human VEGF$_{165}$ (17.5 ng/mL/4.56E-10 M final concentration) and pre-incubated for 45 minutes at 25° C. with shaking. The pre-incubated sample/hVEGF$_{165}$ complex was added to the coated plate at 50 μL in duplicate and incubated for 30 minutes at 25° C. with shaking. Following incubation, plates were washed four times with wash buffer. Streptavidin-polyHRP-40 (Fitzgerald cal#65r-s104phrp) was diluted in assay diluent (10% Superblock containing 0.05% surfactamps) and added to plates (50 μL) for 45 minutes at 25° C. with shaking. Plates were washed four times with wash buffer and developed with the addition of Enhanced K-blue TMB substrate (Neogen cat#308177). The reaction was stopped with 2N sulfuric acid (VWR, cat# BDH3500-1) and the absorbance was read at 450 nm-570 nm. A decrease in observed optical density indicates the test molecule is blocking the hVEGF$_{165}$ binding to the hVEGF-R2-Fc. Data was analyzed using Softmax Pro 4.8 software and IC$_{50}$ values calculated using a sigmoidal dose response (variable slope) fit in GraphPad Prism 5.

Example 1.5: Mouse VEGF-A Blocking Activity Determined by Inhibition of Mouse VEGF-R2 Interaction with Mouse VEGF$_{164}$ To identify molecules that could block the binding of mVEGF$_{164}$ to the mVEGF-R2, a competition ELISA was performed. 96-well Costar high binding plates (#3369) were coated with 2 μg/mL anti-human IgG-Fc (Thermo-Scientific, cat 31125) shaken for 2 hours at 25° C. and stored overnight at 4° C. Plates were washed four times with wash buffer (TBS, 0.05% Tween-20) and 1 μg/mL/4.55E-9 M recombinant mouse VEGF-R2-Fc (R&D Systems cat#443-KD)(50 μL/well in D-PBS) was added to wells and incubated for 1.5 hour at 25° C. with shaking. Plates were then washed four times with wash buffer (TBS, 0.05% Tween-20) and blocked with Superblock blocking buffer (Thermo Scientific, cat#37535). During the blocking step, hybridoma supernatants were diluted in 1% Blocker BSA (Thermo Scientific cat#37525). The mouse VEGF$_{164}$ (R&D Systems cat#493-MV-005) was diluted in 1% Blocker BSA to 20 ng/mL. The diluted sample was added to the mouse VEGF$_{164}$ (10 ng/mL/5.15E-10 M final concentration) and pre-incubated for 45 minutes at 25° C. with shaking. The pre-incubated sample/mVEGF$_{164}$ complex was added to the coated plate at 50 μL and incubated for 30 minutes at 25° C. with shaking. Following incubation, plates were washed four times with wash buffer. The detection reagent biotinylated goat anti-mVEGF$_{164}$ (R&D Systems cat#BAF-493) was diluted in assay diluent (10% Superblock containing 0.05% surfactamps) and added to plates for 1 hour at 25° C. with shaking. Following incubation, plates were washed four times with wash buffer. Streptavidin-polyHRP-40 (Fitzgerald cat#65r-s104phrp) was diluted in assay diluent and added to plates (50 μK) for 45 minutes at 25° C. with shaking. Plates were washed four times with wash buffer and developed with the addition of Enhanced K-blue TMB substrate (Neogen cat#308177). The reaction was stopped with 2N sulfuric acid (VWR, cat# BDH3500-1) and the absorbance was read at 450 nm-570 nm. A decrease in observed optical density indicates the test molecule is blocking the mVEGF$_{164}$ binding to the mouse VEGF-R2-Fc. Data was analyzed using Softmax Pro 4.8 software and IC$_{50}$ values calculated using a sigmoidal dose response (variable slope) fit in GraphPad Prism 5.

Example 1.6: VEGF-A Blocking Activity Determined by VEGFR2 (Tyr1054) Phosphorylation To test candidate molecules for the ability to neutralize hVEGF-A activity, a cell based human VEGF-R2 (KDR/Flk-1) phosphorylation assay was performed. Stably transfected VEGFR2-3T3 cells (AP) were trypsinized, washed in D-PBS and resuspended at 3.5E5 cells/mL in growth media assay (DMEM, 2 mM L-glutamine, 100 units/mL penicillin/100 µg/mL streptomycin, 0.1% MEM non-essential amino acids, 1 mM sodium pyruvate, 400 µg/mL geneticin and 10% FBS). Cells were plated at 3.5E4 cells/well in 96-well plates (Costar cat#3599) and incubated for 6 hours at 37° C., 5% $CO_2$. Growth media was removed and cells were washed with D-PBS. Starvation media was added to wells (DMEM, 2 mM L-glutamine, 100 units/mL penicillin/100 µg/mL streptomycin and 1 mM sodium pyruvate) and cells were incubated for 18 hours at 37° C., 5% $CO_2$. The following day, the MSD anti-VEGFR2-phospho assay plate (Mesoscale VEGFR2-Tyr1054 phospho-MSD kit cat# K151DJD-2) was blocked with MSD Blocker-A for 1 hour at 25° C. with shaking. During blocking, anti-VEGF-A monoclonal antibodies, benchmark compounds or DVD-Ig were serially diluted in growth media and pre-incubated with recombinant human $VEGF_{165}$ (AP, PR-1350437) (50 ng/ml/1.3E-9 M final concentration), $hVEGF_{111}$ (R&DSystems, cat#5336-VE-10/CF) (50 ng/mL/1.9E-9 M final concentration) or rabbit $VEGF_{165}$ (AbbVie, PR-1563693.0) (50 ng/mL/1.24E-9 M final concentration) for 30 minutes at 25° C. with shaking. Starvation media was removed from wells and pre-incubated sample added to cells in duplicate (100 µL) for 8 minutes at 37° C., 5% $CO_2$ Immediately following incubation, plates were transferred to ice where media was removed and cells washed with ice-cold D-PBS. Plates were frozen for 10 minutes at –80° C. Ice-cold lysis buffer (CST cat#9803S) containing 1 mM PMSF was added to cells (50 µL) on ice. Plates were centrifuged at 3000 rpm for 15 minutes at 4° C. The MSD plate was washed four times with wash buffer (TBS, 0.05% Tween-20). The cell lysates were transferred to MSD plate (40 µL) and incubated for 1 hour at 25° C. with shaking. Following incubation, the MSD plate was washed four times with wash buffer. The anti-phospho-Tyr1054-IgG-sulfotag reagent was diluted in detection solution (K151DJD-2 components) and 25 µL added to foil covered wells for 1 hour at 25° C. with shaking. Plates were washed four times with wash buffer, 150 µL MSD read buffer (K151DJD-2 component) added to wells and plates read on MSD Sector Imager 6000. A decrease in observed signal indicates the test molecule is neutralizing the hVEGF-A mediated activation. Data was analyzed using Graphpad Prism software and $IC_{50}$ values calculated using a sigmoidal dose response (variable slope) fit in GraphPad Prism 5.

Example 1.7: VEGF-A Blocking Activity Determined by Inhibition of Human $VEGF_{165}$ Stimulated VEGFR2-3T3 Cell Proliferation/Survival To screen candidate molecules for the ability to neutralize $hVEGF_{165}$ activity, a cell based proliferation assay was performed. Stably transfected VEGFR2-3T3 cells (AP) were trypsinized, washed in D-PBS and resuspended at 8.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 4,250 cells/well (50 µL) on black 96-well plates and incubated for 24 hours at 37° C., 5% $CO_2$. The following day, anti-VEGF-A monoclonal antibodies, benchmark compounds or DVD-Ig were serially diluted in assay media and pre-incubated with recombinant human $VEGF_{165}$ (AP, PR-1350437) (40 ng/ml/1.04E-9 M final concentration in assay well) for 1 hour at 25° C. with gentle shaking. The pre-incubated samples were then added to the cells (50 µL) in triplicate and plates were incubated at 37° C., 5% CO2 for 72 hours. Cell survival/proliferation was measured indirectly by assessing ATP levels using an ATPlite kit (Perkin Elmer, Waltham, Mass.) according to the manufacturer's instructions. A decrease in observed signal indicates the test molecule is neutralizing the $hVEGF_{165}$ induced proliferation. Data was analyzed and $IC_{50}$ values calculated using a sigmoidal dose response (variable slope) fit in GraphPad Prism 5.

Example 1.8: VEGF-A Blocking Activity Determined by Inhibition of Human$VEGF_{111}$ and Human$VEGF_{121}$ Stimulated VEGFR2-3T3 Cell Proliferation/Survival To test the ability of candidate molecules to neutralize $hVEGF_{111}$ and $hVEGF_{121}$ activity, a cell based proliferation assay was performed. Stably transfected VEGFR2-3T3 cells (AP) were trypsinized, washed in D-PBS and resuspended at 8.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 4,250 cells/well (50 µL) on black 96-well plates and incubated for 24 hours at 37° C., 5% $CO_2$. The following day, anti-VEGF-A monoclonal antibodies, benchmark compounds or DVD-Ig were serially diluted in assay media and pre-incubated with either recombinant human $VEGF_{111}$ (R&D Systems, cat#5336-VE) (10 ng/ml/3.85E-10 M final concentration) or human $VEGF_{121}$ (R&D Systems, cat#4644-VS) (10 ng/ml/3.57E-10 M final concentration in assay well) for 1 hour at 25° C. with gentle shaking. The pre-incubated samples were then added to the cells (50 µL) in triplicate and plates were incubated at 37° C., 5% $CO_2$ for 72 hours. Cell survival/proliferation was measured indirectly by assessing ATP levels using an ATPlite kit (Perkin Elmer, Waltham, Mass.) according to the manufacturer's instructions. A decrease in observed signal indicates the test molecule is neutralizing the $hVEGF_{111}$ or $hVEGF_{121}$ induced proliferation. Data was analyzed and $IC_{50}$ values calculated using a sigmoidal dose response (variable slope) fit in GraphPad Prism 5.

Example 1.9: VEGF-A Blocking Activity Determined by Inhibition of Rabbit $VEGF_{165}$ Stimulated VEGFR2-3T3 Cell Proliferation/Survival To screen candidates for the ability to neutralize rabbit-$VEGF_{165}$, a cell based proliferation assay was performed. Stably transfected VEGFR2-3T3 cells (AP) were trypsinized, washed in D-PBS and resuspended at 8.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 4,250 cells/well (50 µL) on black 96-well plates and incubated for 24 hours at 37° C., 5% $CO_2$.

The following day, anti-VEGF-A monoclonal antibodies, benchmark compounds or DVD-Ig were serially diluted in assay media and pre-incubated with recombinant rabbit VEGF$_{165}$ (AbbVie, PR-1563693.0) (40 ng/ml/9.92E-10M final concentration in assay well) for 1 hour at 25° C. with gentle shaking. The pre-incubated samples were then added to the cells (50 μL) in triplicate and plates were incubated at 37° C., 5% CO$_2$ for 72 hours. Cell survival/proliferation was measured indirectly by assessing ATP levels using an ATPlite kit (Perkin Elmer, Waltham, Mass.) according to the manufacturer's instructions. A decrease in observed signal indicates the test molecule is neutralizing the rabbitVEGF$_{165}$ induced proliferation. Data was analyzed and IC$_{50}$ values calculated using a sigmoidal dose response (variable slope) fit in GraphPad Prism 5.

Example 1.10: VEGF-A Blocking Activity Determined by Inhibition of Human VEGF$_{165}$ Stimulated Endothelial Cell Proliferation/Survival To test for the ability to neutralize hVEGF$_{165}$, a cell based proliferation assay was performed. Human microvascular endothelial cells (Lonza, cat#CC-2516) were maintained in EBM-2 (Lonza cat#CC3156) supplemented with EGM-2V singlequots (Lonza cat#3202). The day of the assay, the cells (passage 2-7) were trypsinized, washed in D-PBS and resuspended at 1E5 cells/mL in assay media (M199, 2 mM L-glutamine, 100 units/mL penicillin/100 μg/mL streptomycin, 10 mM HEPES and 10% FBS). Cells were plated at 5,000 cells/well (50 μL) on 96-well gelatin coated plates (BD Biocoat cat#354689) and incubated at 37° C., 5% CO$_2$. The anti-VEGF-A monoclonal antibodies, benchmark compounds or DVD-Ig were serially diluted in assay media and pre-incubated with recombinant human VEGF$_{165}$ (AP, PR-1350437) (5 ng/ml/1.3E-10 M final concentration in assay well) for 1 hour at 25° C. with gentle shaking. The pre-incubated samples were then added to the cells (50 μL) in triplicate and plates were incubated at 37° C., 5% CO$_2$ for 72 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the hVEGF$_{165}$ induced proliferation. Data was analyzed and IC$_{50}$ values calculated using a sigmoidal dose response (variable slope) fit in GraphPad Prism 5.

Example 1.11: Generation of Naturally Derived Human VEGF-A and Reactivity to the Anti-VEGF Antibodies or Anti-VEGF-A/Anti-PDGF-BB DVD-Ig Proteins To identify molecules that could bind naturally derived human VEGF-A, a sandwich ELISA was performed. Native human VEGF-A was obtained from the supernatant of Y-79 cells (ATCC, cat#HTB-18) grown in the presence of dimethyloxalylglycine (Sigma-Aldrich, cat#D3695). The naturally derived material was quantified using the R&D Systems VEGF Duoset kit (cat#DY293B). 96-well Costar high binding plates (#3369) were coated with 13.3E-8 M antibodies, benchmark compounds or DVD-Ig in D-PBS, shaken for 2 hours at 25° C. and stored overnight at 4° C. Plates were blocked with Superblock blocking buffer (Thermo Scientific, cat#37535) followed by four washes with wash buffer (TBS, 0.05% Tween-20). The naturally derived human VEGF-A supernatant was serially diluted in assay diluent (1% Blocker BSA; Pierce, cat#37525) for final test concentrations of 2900 ng/mL-11.88 ng/mL. The dilutions were added to the plates (50 μL) and incubated for 2 hours at 25° C. with shaking. Following incubation, plates were washed four times with wash buffer. Detection antibody from the R&D Systems Duoset kit (Part 840163, cat#DY293B) was diluted in assay diluent and added to plates (50 μL) for 2 hours at 25° C. with shaking. Plates were then washed four times with wash buffer. The streptavidin-HRP from the R&D Systems Duoset kit (Part 890803, cat#DY293B) was diluted in assay diluent and added to plates (50 μL) for 35 minutes at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. An increase in optical density indicates binding of the test molecule to the naturally derived human VEGF-A. Data was analyzed using Softmax Pro 4.8 software and IC$_{50}$ values calculated using a sigmoidal dose response (variable slope) fit in GraphPad Prism 5.

Example 1.12: PDGF-BB Binding Activity Determined by Capture ELISA

To identify molecules that could bind hPDGF-BB, a direct binding ELISA was performed. 96-well high binding neutravidin plates (Thermo Scientific cat#15507) were coated with 0.5 μg/mL/1.99E-8 M recombinant human PDGF-BB-biotin (CST cat#8912BF; labeled at AbbVie, 50 μL/well in D-PBS), shaken for 2 hours at 25° C. During the coating step, supernatants, benchmark compounds or DVD-Ig were diluted in 10% Superblock (Thermo Scientific, cat#37525) and an eight point titration of each sample molecule was performed. Plates were then washed four times with wash buffer (TBS, 0.05% Tween-20). The sample molecule titration was added to the coated plate at 50 μL in duplicate and incubated for one hour at 25° C. with shaking. Following incubation, plates were washed four times with wash buffer. The appropriate anti-species-IgG HRP conjugate was in assay diluent (10% Superblock containing 0.05% surfactamps) and added to plates (50 μL) for one hour at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. An increase in optical density indicates binding of the test molecule to biotinylated recombinant human PDGF-BB. Data was analyzed using Softmax Pro 4.8 software and IC$_{50}$ values calculated using a sigmoidal dose response (variable slope) fit in GraphPad Prism 5.

Example 1.13: PDGF-BB Blocking Activity Determined by Inhibition of PDGF-Rβ Interaction with Human PDGF-BB To identify molecules that could block the binding of hPDGF-BB to the hPDGF-Rβ, a competition ELISA was performed. 96-well Costar high binding plates (#3369) were coated with 0.5 μg/mL/2.98E-9 M recombinant human PDGF-Rβ-Fc (R&D Systems #385-PR, 50 μL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatants, antibodies, benchmark compounds or DVD-Ig were diluted in assay diluent (10%

Superblock containing 0.05% surfactamps) and an eight point titration of each sample molecule was performed. The recombinant human PDGF-BB-biotin (CST cat#8912BF; labeled at AbbVie) was diluted in assay diluent at 20 ng/mL. The sample molecule titration was added to the human PDGF-BB-biotin (10 ng/mL/3.97E-10 M final concentration) and pre-incubated for 45 minutes at 25° C. with shaking. The pre-incubated sample/PDGF-BB complex was added to the coated plate at 50 µL in duplicate and incubated for 35 minutes at 25° C. with shaking. Following incubation, plates were washed four times with wash buffer. Detection reagent Streptavidin-polyHRP-40 (Fitzgerald, cat#65r-s104phrp) was diluted in assay diluent and added to plates (50 µL) for 45 minutes at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. A decrease in observed optical density indicates the test molecule is blocking the hPDGF-BB binding to the human PDGF-Rβ-Fc. Data was analyzed using Softmax Pro 4.8 software and $IC_{50}$ values calculated using a sigmoidal dose response (variable slope) fit in GraphPad Prism 5.

Example 1.14: PDGF-BB Blocking Activity Determined by PDGFRβ (Tyr751) Phosphorylation To test candidate molecules for the ability to neutralize hPDGF-BB activity, a cell based PDGF-Rβ phosphorylation assay was performed. Balb-3T3 cells (ATCC cat# CCL-163) were trypsinized, washed in D-PBS and resuspended at 3.5E5 cells/mL in growth media assay (DMEM, 2 mM L-glutamine, 100 units/mL penicillin/100 µg/mL streptomycin, 0.1% MEM non-essential amino acids, 1 mM sodium pyruvate, and 10% FCS). Cells were plated at 3.5E4 cells/well in 96-well plates (Costar cat#3599) and incubated for 20 hours at 37° C., 5% $CO_2$. Growth media was removed and cells were washed with D-PBS. Starvation media was added to wells (DMEM, 2 mM L-glutamine, 100 units/mL penicillin/100 µg/mL streptomycin and 1 mM sodium pyruvate) and cells were incubated for 18 hours at 37° C., 5% $CO_2$. The following day, the MSD anti-PDGF-Rβ phosphoassay plate (Mesoscale PDGF-Rβ-Tyr751 phospho-MSD kit cat# K150DVD-2) was blocked with MSD Blocker-A for 1 hour at 25° C. with shaking. During blocking, anti-PDGF-BB supernatants, monoclonal antibodies, benchmark compounds or DVD-Ig were serially diluted in growth media and pre-incubated with recombinant human PDGF-BB (CST, cat#8912BF) (20 ng/ml/7.94E-10 M final concentration) and rat PDGF-BB (R&D Systems,cat#520-BB) (70 ng/ml/1.4E-9 M final concentration) for 30 minutes at 25° C. with shaking. Starvation media was removed from wells and pre-incubated sample added to cells in duplicate (100 µL) for 8 minutes at 37° C., 5% $CO_2$. Immediately following incubation, plates were transferred to ice where media was removed and cells washed with ice-cold D-PBS. Plates were frozen for 10 minutes at −80° C. On ice, ice-cold lysis buffer (CST cat#9803S) containing 1 mM PMSF was added to cells (50 µL). Plates were centrifuged at 3000 rpm for 15 minutes at 4° C. The MSD plate was washed four times with wash buffer (TBS, 0.05% Tween-20). The cell lysates were transferred to MSD plate (40 µL) and incubated 1 hour at 25° C. with shaking. Following incubation, the MSD plate was washed four times with wash buffer. The anti-phospho-Tyr751-IgG-sulfotag reagent was diluted in detection solution (K150DVD-2 components) and 25 µl added to foil covered wells for 1 hour at 25° C. with shaking. Plates were washed four times with wash buffer, 150 µL MSD read buffer (K150DVD-2 component) added to wells and plates read on MSD Sector Imager 6000. A decrease in observed reporter signal indicates the test molecule is neutralizing the hPDGF-BB mediated activation. Data was analyzed using Graphpad Prism software and $IC_{50}$ values calculated using a sigmoidal dose response (variable slope) fit in GraphPad Prism 5.

Example 1.15: PDGF-BB Blocking Activity Determined by Inhibition of Human PDGF-BB Stimulated NIH-3T3 Cell Proliferation/Survival To screen candidate molecules for the ability to neutralize hPDGF-BB activity, a cell based proliferation assay was performed. NIH-3T3 cells (ATCC, cat#CRL-1658) were trypsinized, washed in D-PBS and resuspended at 4.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 2,250 cells/well (50 µL) on black 96-well plates and incubated for 5 hours at 37° C., 5% $CO_2$. During cell incubation, anti-PDGF-BB monoclonal antibodies, benchmark compounds or DVD-Ig were serially diluted in assay media and pre-incubated with recombinant human PDGF-BB (CST, cat#8912BF) (1.67 ng/ml/6.63E-11 M final concentration) for 1 hour at 25° C. with gentle shaking. The pre-incubated samples were then added to the cells (50 µL) in triplicate and plates were incubated at 37° C., 5% $CO_2$ for 44 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the hPDGF-BB induced proliferation. Data was analyzed and $IC_{50}$ values calculated using a sigmoidal dose response (variable slope) fit in GraphPad Prism 5.

Example 1.16: PDGF-BB Blocking Activity Determined by Inhibition of Cynomolgus PDGF-BB Stimulated NIH-3T3 Cell Proliferation/Survival To screen candidate molecules for the ability to neutralize cynomolgus PDGF-BB activity, a cell based proliferation assay was performed. NIH-3T3 cells (ATCC, cat#CRL-1658) were trypsinized, washed in D-PBS and resuspended at 4.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 2,250 cells/well (50 µL) on black 96-well plates and incubated for 5 hours at 37° C., 5% $CO_2$. During cell incubation, anti-PDGF-BB monoclonal antibodies, benchmark compounds or DVD-Ig were serially diluted in assay media and pre-incubated with recombinant cynomolgus PDGF-BB (AP, PR-1575400) (4 ng/ml/1.61E-10 M final concentration in assay well) for 1 hour at 25° C. with gentle shaking. The pre-incubated samples were then added to the cells (50 µL) in triplicate and plates were incubated at 37° C., 5% $CO_2$ for 44 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the cynoPDGF-BB

Example 1.17: PDGF-BB Blocking Activity Determined by Inhibition of Murine PDGF-BB Stimulated NIH-3T3 Cell Proliferation/Survival To test candidate molecules for the ability to neutralize mouse PDGF-BB activity, a cell based assay was performed. NIH-3T3 cells (ATCC, cat#CRL-1658) were trypsinized, washed in D-PBS and resuspended at 4.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 2,250 cells/well (50 µL) on black 96-well plates and incubated for 5 hours at 37° C., 5% $CO_2$. During cell incubation, anti-PDGF-BB monoclonal antibodies, benchmark compounds or DVD-Ig were serially diluted in assay media and pre-incubated with recombinant murine PDGF-BB (Abnova, cat#0309-200-58-S) (2 ng/ml/8.13E-11 M final concentration) for 1 hour at 25° C. with gentle shaking. The pre-incubated samples were then added to the cells (50 µL) in triplicate and plates were incubated at 37° C., 5% $CO_2$ for 44 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the murine PDGF-BB induced proliferation. Data was analyzed and $IC_{50}$ values calculated using a sigmoidal dose response (variable slope) fit in GraphPad Prism 5.

Example 1.18: PDGF-BB Blocking Activity Determined by Inhibition of Rat PDGF-BB Stimulated NIH-3T3 Cell Proliferation/Survival To test candidate molecules for the ability to neutralize rat PDGF-BB activity, a cell based assay was performed. NIH-3T3 cells (ATCC, cat#CRL-1658) were trypsinized, washed in D-PBS and resuspended at 4.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 2,250 cells/well (50 µL) on black 96-well plates and incubated for 5 hours at 37° C., 5% $CO_2$. During cell incubation, anti-PDGF-BB monoclonal antibodies, benchmark compounds or DVD-Ig were serially diluted in assay media and pre-incubated with recombinant rat PDGF-BB (R&D Systems,cat#520-BB) (2 ng/ml/8.0E-11 M final concentration) for 1 hour at 25° C. with gentle shaking. The pre-incubated samples were then added to the cells (50 µL) in triplicate and plates were incubated at 37° C., 5% $CO_2$ for 44 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the rat PDGF-BB induced proliferation. Data was analyzed and $IC_{50}$ values calculated using a sigmoidal dose response (variable slope) fit in GraphPad Prism 5.

Example 1.19: Generation of Naturally Derived Human PDGF-BB and Reactivity to the Anti-PDGF-BB Antibodies or Anti-VEGF-A/Anti-PDGF-BB DVD-Ig Proteins The native form of human PDGF was purified from platelets by a modified protocol from Antoniades et al. (Antoniades et al. (1979) Proc. Natl. Acad. Sci. USA 76(4): 1809-1813. In the modified protocol, ten units of platelets (Bioreclamation Inc.) were thawed, washed with 12 ml of Platelet Wash Buffer (HBSS—Gibco #14175/0.3% BSA/10 mM EDTA) and centrifuged. The platelets were then suspended in 25 ml of Buffer A (20 mM NaHPO4, pH 7.4, 80 mM NaCl in a 50 ml tube). From here the platelet wash (50 ml tube) and the suspended platelets were worked up in parallel using the same protocol.

Both the suspended platelets and platelets wash tubes were placed into a boiling water bath for 10 minutes, after which the contents of the tubes were cooled on ice. The supernatant was separated from the pellet by centrifugation. The supernatant was placed aside at 4° C. and the pellet was extracted with 30 ml Buffer B (20 mM NaHPO4, pH 7.4, 1M NaCl) by stirring overnight at 4° C. The supernatant was separated from the pellet by centrifugation. The supernatant was placed aside (4° C.) and the pellet was extracted with 30 ml Buffer B by stirring overnight at 4° C. This was repeated two more times. All the supernatants were then dialyzed separately against Buffer A. After removal from dialysis, they were all analyzed for protein content and PDGF-BB (ELISA) (See Table 6).

TABLE 6

Native PDGF Extraction from Human Platelets

| Sample | Volume (ml) | PDGF-BB (ng/mL) | Total PDGF-BB (ng) | Protein (mg/mL) | Total Protein (mg) | ng PDGF-BB per mg Protein |
|---|---|---|---|---|---|---|
| Boiled platelet | | | | | | |
| Supernatant | 50 | 4.52 | 226.18 | 0.63 | 31.50 | 7.18 |
| Pellet | | | | | | |
| Extraction 1 | 35 | 8.77 | 306.95 | 0.31 | 10.85 | 28.29 |
| Extraction 2 | 35 | 3.79 | 132.76 | 0.25 | 8.58 | 15.48 |
| Extraction 3 | 35 | 1.26 | 44.03 | 0.10 | 3.43 | 12.83 |
| Extraction 4 | 37 | 1.53 | 56.65 | 0.19 | 7.03 | 8.05 |
| Platelet Wash Boiled | | | | | | |
| Supernatant | 27 | 7.49 | 202.12 | 0.64 | 17.28 | 11.70 |
| Extracted Pellet | 37 | 10.89 | 402.75 | 0.90 | 33.15 | 12.15 |
| Total | 256 | 5.36 | 1371.32 | 0.44 | 111.82 | 12.26 |

TABLE 7

Native PDGF Purification from Human Platelets

| Platelet Purification | PDGF-BB (ng/mL) | Volume (mL) | Total PDGF-BB (ng) | Total Protein (mg) | Specific Activity ng PDGF/mg Protein | Endotoxin Levels | | |
|---|---|---|---|---|---|---|---|---|
| | | | | | | EU/ml | EU/mg protein | EU/µg PDGF |
| Eluate 1 | 214.94 | 6.74 | 1449 | 0.443 | 3266.49 | 2.36 | 35.87 | 10.98 |
| Flow Thru 1 | 1.17 | 500 | 585 | 110.5 | 5.29 | | | |

Due to low specific activity (ng PDGF-BB per mg protein), the supernatants were subjected to further purification by CM sepharose. The supernatants were applied (with washing Buffer A) to a 20 ml CM sepharose column (GE Healthcare cat#17-0719-01) and the PDGF was eluted with Buffer B. Subsequently the eluted protein was dialyzed against Buffer A. From here the protein that was eluted and subsequently dialyzed as well as the flow through were all analyzed for protein content and PDGF-BB (ELISA). At this point the specific activity (eluate 1) was high enough to be queried in the assay.

To identify molecules that could bind naturally derived human PDGF-BB, a sandwich ELISA was performed. The native human PDGF-BB was isolated and purified from human platelets (AbbVie, PR-1566692). This material was quantified using the R&D Systems PDGF-BB Duoset kit (cat#DY220). 96-well Costar high binding plates (#3369) were coated with 13.3E-8 M antibodies, benchmark compounds or DVD-Ig in D-PBS, shaken for 2 hours at 25° C. and stored overnight at 4° C. Plates were blocked with Superblock blocking buffer (Thermo Scientific, cat#37535) followed by four washes with wash buffer (TBS, 0.05% Tween-20). The native human PDGF-BB was serially diluted in assay diluent (1% Blocker BSA; Pierce, cat#37525) for final test concentrations of 2000 ng/mL-2.74 ng/mL (5.4E-8 M-7.5E-11 M). The dilutions were added to the plates (50 µL) and incubated for 2 hours at 25° C. with shaking. Following incubation, plates were washed four times with wash buffer. Detection antibody from the R&D Systems Duoset kit (Part 840926, cat#DY220) was diluted in assay diluent and added to plates (50 µL) for 2 hours at 25° C. with shaking. Plates were then washed four times with wash buffer. The streptavidin-HRP from the R&D Systems Duoset kit (Part 890803, cat#DY220) was diluted in assay diluent and added to plates (50 µL) for 35 minutes at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. An increase in optical density indicates binding of the test molecule to the naturally derived human PDGF-BB. Data was analyzed using Softmax Pro 4.8 software and $IC_{50}$ values calculated using a sigmoidal dose response (variable slope) fit in GraphPad Prism 5.

Example 1.20: hVEGF-A Neutralization Potency of Anti-VEGF-A/Anti-PDGF-BB DVD-Ig Proteins when Pre-Incubated with hPDGF-BB To test candidate molecules for the ability to neutralize hVEGF-A activity in the presence of hPDGF-BB, a cell based VEGF-R2 (KDR/Flk-1) phosphorylation assay was performed. Stably transfected VEGFR2-3T3 cells (AP) were trypsinized, washed in D-PBS and resuspended at 3.5E5 cells/mL in growth media assay (DMEM, 2 mM L-glutamine, 100 units/mL penicillin/100 µg/mL streptomycin, 0.1% MEM non-essential amino acids, 1 mM sodium pyruvate, 400 µg/mL geneticin and 10% FBS). Cells were plated at 3.5E4 cells/well in 96-well plates (Costar cat#3599) and incubated for 6 hours at 37° C., 5% $CO_2$. Growth media was removed and cells were washed with D-PBS. Starvation media was added to wells (DMEM, 2 mM L-glutamine, 100 units/mL penicillin/100 µg/mL streptomycin and 1 mM sodium pyruvate) and cells were incubated for 18 hours at 37° C., 5% $CO_2$. The following day, the MSD anti-VEGFR2-phospho assay plate (Mesoscale VEGFR2-Tyr1054 phospho-MSD kit, cat#K151DJD-2) was blocked with MSD Blocker-A for 1 hour at 25° C. with shaking. During blocking, anti-VEGF-A monoclonal antibodies, benchmark compounds or DVD-Ig were serially diluted in growth media and pre-incubated with recombinant human PDGF-BB (CST cat#8912BF) (0.992 µg/ml/3.94E-8 M final concentration) for 30 minutes at 25° C. with shaking. Following the first pre-incubation step, recombinant human $VEGF_{165}$ (AP, PR-1350437) was added to the samples for a final concentration of human $VEGF_{165}$ of 50 ng/ml/1.3E-9 M and of hPDGF-BB of 0.496 µg/ml/1.97E-8 M final concentration for 30 minutes at 25° C. with shaking. Starvation media was removed from wells and pre-incubated sample added to cells in duplicate (100 µL) for 8 minutes at 37° C., 5% $CO_2$. Immediately following incubation, plates were transferred to ice where media was removed and cells washed with ice-cold D-PBS. Plates were frozen for 10 minutes at −80° C. Ice-cold lysis buffer (CST cat#9803S) containing 1 mM PMSF was added to cells (50 µL) on ice. Plates were centrifuged at 3000 rpm for 15 minutes at 4° C. The MSD plate was washed four times with wash buffer (TBS, 0.05% Tween-20). The cell lysates were transferred to MSD plate (40 µL) and incubated 1 hour at 25° C. with shaking. Following incubation, the MSD plate was washed four times with wash buffer. The anti-phospho-Tyr1054-IgG-sulfotag reagent was diluted in detection solution (K151DJD-2 components) and 25 L added to foil covered wells for 1 hour at 25° C. with shaking. Plates were washed four times with wash buffer, 150 µL MSD read buffer (K151DJD-2 component) added to wells and plates read on MSD Sector Imager 6000. A decrease in observed signal indicates the test molecule is neutralizing the $hVEGF_{165}$ mediated activation in the presence of hPDGF-BB. Data was analyzed using Graphpad Prism software and $IC_{50}$ values calculated using a sigmoidal dose response (variable slope) fit in GraphPad Prism 5.

Example 1.21: PDGF Neutralization Potency of Anti-VEGF-A/Anti-PDGF-BB DVD-Ig Proteins when Pre-Incubated with VEGF To test candidate molecules for the ability to neutralize hPDGF-BB activity in the presence of hVEGF-A, a cell based proliferation assay was performed. NIH-3T3 cells (ATCC, cat#CRL-1658) were trypsinized, washed in D-PBS and resuspended at 4.5E4 cells/mL in assay media (DMEM, 2 mM L-glutamine, 100 units/mL penicillin/100 µg/mL streptomycin, 0.1% MEM non-essential amino acids, 1 mM sodium pyruvate and 0.1% BSA). Cells were plated at 2,250 cells/well (50 µL) on black 96-well plates and incubated for 5 hours at 37° C., 5% $CO_2$. During cell incubation, anti-PDGF-BB monoclonal antibodies, benchmark compounds or DVD-Ig were serially diluted in assay media containing $hVEGF_{165}$ (4 µg/mL/104.2 nM). The samples were pre-incubated with recombinant human PDGF-BB in assay media (CST, cat#8912BF) (3.34 ng/ml/1.33E-10 M final concentration in well) for 1 hour at 25° C. with gentle shaking. The final concentrations of ligand in assay wells were $hVEGF_{165}$ 2.6E-8 M and hPDGF-BB 6.63E-11 M. The pre-incubated samples were added to the cells (50 µL) in triplicate and plates were incubated at 37° C., 5% $CO_2$ for 44 hours. Cell survival/proliferation was measured indirectly by assessing ATP levels using a CellTiter-Glo Luminescent Cell Viability Assay kit (Promega, Madison, Wis.) according to the manufacturer's instructions. A decrease in observed signal indicates the test molecule is neutralizing the hPDGF-BB induced proliferation in the presence of $hVEGF_{165}$. Data was analyzed and $IC_{50}$ values calculated using a sigmoidal dose response (variable slope) fit in GraphPad Prism 5.

Example 1.22: Human VEGF-R2 Binding Activity of the Anti-VEGF-R2 Antibodies

To identify molecules which could bind VEGF-R2 (KDR/Flk-1), a direct binding ELISA was performed. 96-well Costar high binding plates (#3369) were coated with 0.5 µg/mL/2.27E-9 M recombinant human VEGF-R2-Fc (R&D Systems cat#357-KD), 50 µL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatant, antibodies or benchmark compounds were diluted in 1% Blocker BSA (Thermo Scientific cat#37525) and an eight point titration of each sample molecule was performed. The samples were added to wells and incubated for one hour at 25° C. with shaking. Following incubation, plates were washed four times with wash buffer. The appropriate anti-species-IgG HRP conjugate was diluted in assay diluent (10% Superblock containing 0.05% surfactamps) and added to plates (50 µL) for forty-five minutes at 25° C. with shaking. Plates were washed four times with wash buffer and developed with the addition of Enhanced K-blue TMB substrate (Neogen cat#308177). The reaction was stopped with 2N sulfuric acid (VWR, cat# BDH3500-1) and the absorbance was read at 450 nm-570 nm. An increase in observed optical density indicates the test molecule is binding the human VEGF-R2-Fc. Data was analyzed using Softmax Pro 4.8 software and $IC_{50}$ values calculated using a sigmoidal dose response (variable slope) fit in GraphPad Prism 5.

Example 1.23: Human VEGF-R2 Blocking Activity of the Anti-VEGF-R2 Antibodies as Determined by Inhibition of Human VEGF-R2 Interaction with Human $VEGF_{165}$ To identify molecules which could block the binding of VEGF-R2 (KDR/Flk-1) to $hVEGF_{165}$, a competition ELISA was performed. 96-well Costar high binding plates (#3369) were coated with 0.5 µg/mL/2.27E-9 M recombinant human VEGF-R2-Fc (R&D Systems cat#357-KD), 50 µL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatant, antibodies or benchmark compounds were diluted in 1% Blocker BSA (Thermo Scientific cat#37525) and an eight point titration of each sample molecule was performed. The samples were added to wells and incubated for 30 minutes at 25° C. with shaking. The biotinylated human $VEGF_{165}$ (AP, PR-1361002) was diluted in 1% BSA at 35 ng/mL. This was added to wells (17.5 ng/mL/4.56E-10 M final concentration) and incubation was continued for 30 minutes at 25° C. with shaking. Following incubation, plates were washed four times with wash buffer. Streptavidin-polyHRP-40 (Fitzgerald cat#65r-s104phrp) was diluted in assay diluent (10% Superblock containing 0.05% surfactamps) and added to plates (50 µL) for 45 minutes at 25° C. with shaking. Plates were washed four times with wash buffer and developed with the addition of Enhanced K-blue TMB substrate (Neogen cat#308177). The reaction was stopped with 2N sulfuric acid (VWR, cat# BDH3500-1) and the absorbance was read at 450 nm-570 nm. A decrease in observed optical density indicates the test molecule is blocking the human VEGF-R2-Fc binding to $hVEGF_{165}$. Data was analyzed using Softmax Pro 4.8 software and $IC_{50}$ values calculated using a sigmoidal dose response (variable slope) fit in GraphPad Prism 5.

Example 1.24: VEGF-A Blocking Activity of the Anti-VEGF-R2 Antibodies as Determined by VEGFR2 (Tyr1054) Phosphorylation To test candidate molecules for the ability to neutralize hVEGF-R2 activity, a cell based VEGF-R2 (KDR/Flk-1) phosphorylation assay was performed. Stably transfected VEGFR2-3T3 cells (AP) were trypsinized, washed in D-PBS and resuspended at 3.5E5 cells/mL in growth media assay (DMEM, 2 mM L-glutamine, 100 units/mL penicillin/100 µg/mL streptomycin, 0.1% MEM non-essential amino acids, 1 mM sodium pyruvate, 400 µg/mL geneticin and 10% FBS). Cells were plated at 3.5E4 cells/well in 96-well plates (Costar cat#3599) and incubated for 6 hours at 37° C., 5% $CO_2$. Growth media was removed and cells were washed with D-PBS. Starvation media was added to wells (DMEM, 2 mM L-glutamine, 100 units/mL penicillin/100 µg/mL streptomycin and 1 mM sodium pyruvate) and cells were incubated for 18 hours at 37° C., 5% $CO_2$. The following day, the MSD anti-VEGR2-phospho assay plate (Mesoscale VEGFR2-Tyr1054 phospho-MSD #kit cat K151DJD-2) was blocked with MSD Blocked with MSD Blocker-A for 1 hour at 25° C. with shaking. During blocking, anti-VEGF-R2 supernatant, monoclonal antibodies and benchmark compounds were serially diluted in growth media and pre-incubated with recombinant human VEGFR2-Fc (R&D Systems, cat#357-KD) (500 ng/ml/2.27E-9 M final concentration) for 30 minutes at 25° C. with shaking. Recombinant human $VEGF_{165}$ (AP, PR-1350437) (50 ng/ml/1.3E-9 M final concentration) was added to the wells and incubation was continued for 30 minutes at 25° C. with shaking. Starvation media was removed from wells and pre-incubated sample added to cells in duplicate (100 µL) for 8 minutes at 37° C., 5% $CO_2$. Immediately following incubation, plates were transferred to ice where media was removed and cells washed with ice-cold D-PBS. Plates were frozen for 10 minutes at −80° C. Ice-cold lysis buffer (CST cat#9803S) containing 1 mM PMSF was added to cells (50 µL) on ice. Plates were centrifuged at 3000 rpm for 15 minutes at 4° C. The MSD plate was washed four times with wash buffer (TBS, 0.05% Tween-20). The cell lysates were transferred to MSD plate (40 µL) and incubated 1 hour at 25° C. with shaking. Following incubation, the MSD plate was washed four times with wash buffer. The anti-phospho-Tyr1054-IgG-sulfotag reagent was diluted in detection solution (K151DJD-2 components) and 25 µL added to foil covered wells for 1 hour at 25° C. with shaking. Plates were washed four times with wash buffer, 150 µL MSD read buffer (K151DJD-2 component) added to wells and plates read on MSD Sector Imager 6000. An increase in observed signal indicates the test molecule is neutralizing the exogeneous hVEGFR2 and allowing for $hVEGF_{165}$ mediated activation. Data was analyzed using Graphpad Prism software and $IC_{50}$ values calculated using a sigmoidal dose response (variable slope) fit in GraphPad Prism 5.

Example 1.25: Mouse VEGF-R2 Blocking Activity of the Anti-VEGF-R2

Antibodies as Determined by Inhibition of Mouse VEGF-R2 Interaction with Mouse $VEGF_{164}$ To identify molecules which could block the binding of $mVEGF_{164}$ to the mVEGF-R2, a competition ELISA was performed. 96-well Costar high binding plates (#3369) were coated with 1 µg/mL/4.55E-9 M recombinant mouse VEGF-R2-Fc (R&D Systems cat#443-KD)(50 µL/well in D-PBS) shaken for 2 hours at 25° C. and stored overnight at 4° C. Plates were washed four times with wash buffer (TBS, 0.05% Tween-20). Plates were then washed four times with wash buffer (TBS, 0.05% Tween-20) and blocked with Superblock blocking buffer (Thermo Scientific, cat#37535). During the blocking step, hybridoma supernatants and rat IgG were diluted in 1% Blocker BSA (Thermo Scientific cat#37525). The sample was added to the plates (50 µL) and incubated for 45 minutes at 25° C. with shaking. The mouse $VEGF_{164}$ (R&D Systems cat#493-MV-005) was diluted in 1% Blocker BSA to 20 ng/mL and added to wells for a final concentration of 10 ng/mL/5.15E-10 M final concentration. Incubation was continued for 30 minutes at 25° C. with shaking. Following incubation, plates were washed four times with wash buffer. The detection reagent biotinylated goat anti-$mVEGF_{164}$ (R&D Systems cat#BAF-493) was diluted in assay diluent (10% Superblock containing 0.05% surfactamps) and added to plates for 1 hour at 25° C. with shaking. Following incubation, plates were washed four times with wash buffer. Streptavidin-polyHRP-40 (Fitzgerald cat#65r-s104phrp) was diluted in assay diluent and added to plates (50 µL) for 45 minutes at 25° C. with shaking. Plates were washed four times with wash buffer and developed with the addition of Enhanced K-blue TMB substrate (Neogen cat#308177). The reaction was stopped with 2N sulfuric acid (VWR, cat# BDH3500-1) and the absorbance was read at 450 nm-570 nm. A decrease in observed optical density indicates the test molecule is blocking the mouse VEGF-R2-Fc binding to the $mVEGF_{164}$. Data was analyzed using Softmax Pro 4.8 software and $IC_{50}$ values calculated using a sigmoidal dose response (variable slope) fit in GraphPad Prism 5.

Example 1.26: PDGF-Rβ Binding Activity of the Anti-PDGF-Rβ Antibodies

To identify molecules which bind hPDGF-Rβ, a direct ELISA was performed. 96-well Costar high binding plates (#3369) were coated with 0.5 µg/mL/2.98E-9 M recombinant human PDGF-Rβ-Fc (R&D Systems #385-PR, 50 µL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatants, antibodies and benchmark compounds were diluted in assay diluent (10% Superblock containing 0.05% surfactamps) and an eight point titration of each sample molecule was performed. The samples were added to wells and incubated for one hour at 25° C. with shaking. Following incubation, plates were washed four times with wash buffer. The appropriate anti-species-IgG HRP conjugate was diluted in assay diluent (10% Superblock containing 0.05% surfactamps) and added to plates (50 µL) for forty-five minutes at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. An increase in observed optical density indicates the test molecule is binding the human PDGF-Rβ-Fc. Data was analyzed using Softmax Pro 4.8 software and $IC_{50}$ values calculated using a sigmoidal dose response (variable slope) fit in GraphPad Prism 5.

Example 1.27: PDGF-Rβ Blocking Activity of the Anti-PDGF-Rβ Antibodies as Determined by Inhibition of PDGF-Rβ Interaction with Human PDGF-BB To identify molecules which could block the binding of hPDGF-Rβ to hPDGF-BB, a competition ELISA was performed. 96-well Costar high binding plates (#3369) were coated with 0.5 µg/mL/2.98E-9 M recombinant human PDGF-Rβ-Fc (R&D Systems #385-PR, 50 µL/well in D-PBS), shaken for 2 hours at 25° C. and stored overnight at 4° C. Plates were then washed four times with wash buffer (TBS, 0.05% Tween-20) and blocked with Superblock blocking buffer (Thermo Scientific, cat#37535). During the blocking step, supernatants, antibodies and benchmark compounds were diluted in assay diluent (10% Superblock containing 0.05% surfactamps) and an eight point titration of each sample molecule was performed. The samples were added to wells and incubated for 30 minutes at 25° C. with shaking. The recombinant human PDGF-BB-biotin (CST cat#8912BF; labeled at ABC) was diluted in assay diluent at 20 ng/mL. This was added to wells (10 ng/mL/3.97E-10 M final concentration) and incubation was continued for 35 minutes at 25° C. with shaking. Following incubation, plates were washed four times with wash buffer. Detection reagent Streptavidin-polyHRP-40 (Fitzgerald, cat#65r-s104phrp) was diluted in assay diluent and added to plates (50 µL) for 45 minutes at 25° C. with shaking. Plates were washed four times with wash buffer and developed with the addition of Enhanced K-blue TMB substrate (Neogen, cat#308177). The reaction was stopped with 2N sulfuric acid (VWR, cat# BDH3500-1) and the absorbance was read at 450 nm-570 nm. A decrease in observed optical density indicates the test molecule is blocking the human PDGF-Rβ-Fc binding to hPDGF-BB. Data was analyzed using Softmax Pro 4.8 software and $IC_{50}$ values calculated using a sigmoidal dose response (variable slope) fit in GraphPad Prism 5.

Example 1.28: PDGF-Rβ Blocking Activity of the Anti-PDGF-Rβ Antibodies as Determined by PDGFRβ (Tyr751) Phosphorylation To test candidate molecules for the ability to neutralize hPDGF-Rβ activity, a cell based PDGF-Rβ phosphorylation assay was performed. Balb-3T3 cells (ATCC cat# CCL-163) were trypsinized, washed in D-PBS and resuspended at 3.5E5 cells/mL in growth media assay (DMEM, 2 mM L-glutamine, 100 units/mL penicillin/100 µg/mL streptomycin, 0.1% MEM non-essential amino acids, 1 mM sodium pyruvate, and 10% FCS). Cells were plated at 3.5E4 cells/well in 96-well plates (Costar cat#3599) and incubated for 20 hours at 37° C., 5% $CO_2$. Growth media was removed and cells were washed with D-PBS. Starvation media was added to wells (DMEM, 2 mM L-glutamine, 100 units/mL penicillin/100 µg/mL streptomycin and 1 mM sodium pyruvate) and cells were incubated for 18 hours at 37° C., 5% $CO_2$. The following day, the MSD anti-PDGFRβ-phospho-assay plate (Mesoscale PDGF-Rβ-Tyr751 phospho-MSD kit cat# K150DVD-2) was blocked with MSD Blocker-A for 1 hour at 25° C. with shaking. During blocking, supernatants, antibodies or benchmark compounds were serially diluted in growth media and pre-incubated with 500 ng/mL/2.98E-9 M hPDGF-Rβ (R&D System, cat 385-PR) for 30 minutes at 25° C. Recombinant human PDGF-BB (CST, cat#8912BF) (20 ng/ml/7.94E-10 nM final concentration) was added to the wells and incubation was continued for 30 minutes at 25° C. with shaking. Starvation media was removed from wells and pre-incubated sample added to cells in duplicate (100 µL) for 8 minutes at 37° C., 5% $CO_2$. Immediately following incubation, plates were transferred to ice where media was removed and cells washed with ice-cold D-PBS. Plates were frozen for 10 minutes at −80° C. Ice-cold lysis buffer (CST cat#9803S) containing 1 mM PMSF was added to cells (50 µL) on ice. Plates were centrifuged at 3000 rpm for 15 minutes at 4° C. The MSD plate was washed four times with wash buffer (TBS, 0.05% Tween-20). The cell lysates were transferred to MSD plate (40 µL) and incubated 1 hour at 25° C. with shaking. Following incubation, the MSD plate was washed four times with wash buffer. The anti-phospho-Tyr751-IgG-sulfotag reagent was diluted in detection solution (K150DVD—2 components) and 25 µL added to foil covered wells for 1 hour at 25° C. with shaking. Plates were washed four times with wash buffer, 150 µL MSD read buffer (K150DVD-2 components) added to wells and plates read on MSD Sector Imager 6000. An increase in observed signal indicates the test molecule is neutralizing the exogeneous hPDGF-Rβ and allowing for hPDGF-BB mediated activation. Data was analyzed using Graphpad Prism software and $IC_{50}$ values calculated using a sigmoidal dose response (variable slope) fit in GraphPad Prism 5.

Example 1.29: Reactivity of Anti-PDGF-BB Antibodies and Anti-VEGF-A/anti-PDGF-BB DVD-Ig Molecules to ECM-associated PDGF-BB Both recombinant cell line HEK293 cells over-expressing PDGFBB-RM and HUVEC naturally expressing ECM-associated PDGF-BB cells were used for staining.

HEK293 Cell Staining:

PDGFB-RM transient transfected HEK 293 cells and parental HEK293 cells were re-suspended at 1E6 cells/mL in PBS and fixed in 4% paraformaldehyde at RT for 10 minutes, washed with PBS and 2E5 cells/tube were incubated in blocking buffer (10% goat serum in PBS) for one hour on ice. Cells were washed with PBS and incubated with primary antibodies or DVD-Ig molecules at 33 nM in antibody dilution buffer (5% goat serum in PBS) for one hour on ice. Cells were washed three times with PBS and incubated with Alexa Fluo 488 conjugated Goat anti-Human IgG (Jackson Immune, code: 109-546-098; lot: 108427) 1:400 dilution in antibody dilution buffer, incubated on ice for 45 minutes, cells were washed three times with PBS and cytospin onto glass slides and mounted with mounting media with DAPI. Pictures were taken by fluorescent microscopy.

HUVEC Staining:

The anti-VEGF/anti-PDGF DVD-Ig was further assessed for its staining on naturally derived ECM-associated PDGF-BB on HUVEC cells. HUVECs (Lonza, cat#: C2519A lot: 181607) were trypsinized, resuspended at 2E4 cells/mL in culture media (Lonza, EGM2 MV Bulletkit: CC-3202). Cells were plated at 10,000 cells/500 µl/well in 8-chamber glass slide and incubated for 16 hours at 37° C., 5% $CO_2$. After incubation, cells were fixed with 200 µl 4% paraformaldehyde at RT for 10 minutes, washed with PBS and incubated in blocking buffer (10% goat serum in PBS) for one hour on ice. Cells were washed with PBS 3× and incubated with primary antibodies or DVD-Ig molecules at 33 nM in antibody dilution buffer (5% goat serum in PBS) for one hour on ice. Cells were washed three times with PBS and incubated with Alexa Fluo 488 conjugated Goat anti-Human IgG (JacksonImmune, code: 109-546-098; lot: 108427) 1:400 dilution in antibody dilution buffer, incubate on ice for 45 minutes, cells were washed three times with PBS and mounted with mounting media with DAPI. Pictures were taken by fluorescent microscopy.

Figure 3:
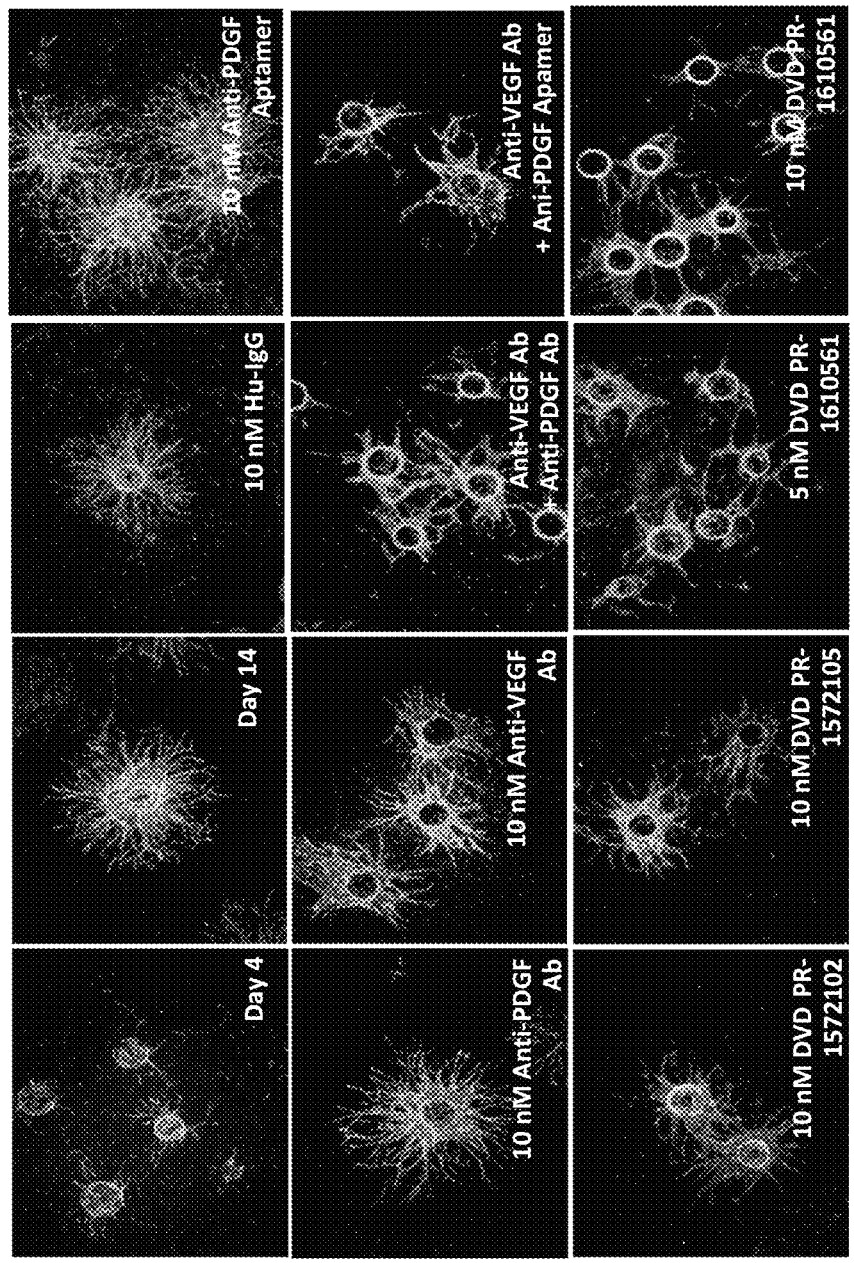
FIG. 3 illustrates the inhibition of sprouting from a HUVEC/MSC co-culture sprouting assay by anti-VEGF-A/anti-PDGF-BB DVD-Ig molecules.

A. Example 1.30: Inhibition of Sprouting in HUVEC/MSC Co-culture Sprouting Assay by Anti-VEGF-A/anti-PDGF-BB DVD-Ig Molecules In early therapeutic treatment mode, Cytodex-3 beads (Sigma-Aldrich, cat# C3275) were coated with HUVEC cells (Lonza) overnight, and then embedded (100 beads/well) with human mesenchymal stem cells (Lonza, 20,000 cells/well) in fibrin gel in 24-well tissue culture plates. A 1:1 mixture of fresh EGM-2 complete media (Lonza) and fibroblast (Lonza) conditioned EGM-2 media were added on top of the fibrin gel along with 2 ng/mL of recombinant human HGF. Medium was replaced every 2-3 days till the end of the experiment. After EC sprouts and pericyte covering were formed usually on day 4, anti-VEGF-A (4G8.4), anti-PDGFBB (9E8.) or anti-PDGFBB/VEGF-A DVD-Ig, were added to the culture medium at 10 nM starting. 10 days later cells were fixed in 4% PFA overnight at 4° C. Endothelial cells were stained with anti-PECAM (Abcam, ab32457), followed by fluorescence-conjugated secondary antibody, and pericytes were labeled with anti-aSMA-Cy3 (Sigma, C6198). Cells were then viewed by an inverted fluorescence microscope and 5× images were captured (FIGS. 2 and 3).

Example 2: Analytical Methods and Techniques for Physicochemical Property Characterizations of DVD-Ig Proteins

Example 2.1: Size Exclusion Chromatography Technique

Size exclusion chromatography (SEC) is used to separate proteins based on size. Proteins are carried in an aqueous mobile phase and through a porous stationary phase resin packed in a column. The retention time in the column is a function of the hydrodynamic size of the protein and the size of the pores in the packed resin bed. Smaller molecules can penetrate into smaller pores in the resin and are retained longer than larger molecules. Samples at 1 mg/ml, or diluted with formulation buffer to this concentration, are injected onto the SEC column at a volume of 10 µl. Upon elution from the column, the proteins are detected by UV absorbance. The SEC method uses a TSK gel guard (TOSOH Biosciences, Montgomeryville, Pa., cat. no. 08543) and a TSK gel G3000SWxL (TOSOH Biosciences, Montgomeryville, Pa., cat. no. 08541). The mobile phase was 100 mM $Na_2HPO_4$, 100 mM $Na_2SO_4$, pH 6.8. The flow rate is 0.25 ml/minute. The column temperature is room temperature. The autosampler temperature is 2-8° C. The total run time is 55 minutes. The detection is based on UV absorbance at 214 nm wavelength, with band width set at 8 nm, using reference wavelength at 360 nm with band width 100 nm. The resulting chromatogram is analysed for the distribution of different size species (aggregate, monomer, and fragment) by the percentage of the total area of the signal.

Example 2.2: Differential Scanning Calorimetry Technique

The thermal stability of the protein samples was assessed using a differential scanning calorimetry (DSC) instrument. The DSC instrument used was an automated VP-DSC equipment with Capillary Cell (Microcal, GE Healthcare Ltd./Microcal, Buckinghamshire, UK). Unfolding of molecules was studied applying a 1° C./minute scan rate over a 25° C.-95° C. temperature range for samples at 1 mg/mL. Additional measurement parameters applied were a fitting period of 16 seconds, a pre-scan wait time of 10 minutes, and measurements were performed in none-feedback mode. For each measurement, 420 µL of sample or blank buffer was filled into the designated receptacle within the DSC instrument. The thermograms obtained (heat capacity versus temperature) were fitted to a non-two state model to obtain the midpoint temperatures and enthalpies of the different transitions.

Example 2.3: Sample Preparation

The antibodies and DVD-Ig molecules were initially obtained as a solution and diluted below 10 mg/ml with the formulation buffer. Each sample was then inserted into a separate dialysis cartridge (Slide-a-lyzer cassette, 10,000 MWCO, 3-12 mL capacity, Thermo Scientific, USA, Cat. No. 66810) and dialyzed against 2 L of the formulation buffer with continuous stirring via a magnetic stir bar for 18-24 hours. The samples were then retrieved from the cartridge and briefly spun down in a centrifuge and/or passed through 0.45 µm PVDF filters to remove any precipitation or particles. This was followed by up-concentration of the DVD-Ig solutions with centrifuge spin filters (Amicon Ultra 30,000 MWCO Regenerated Cellulose) to reach the desired protein concentration which was confirmed by UV measurements at 280 nm. If the solutions were above the desired concentration, they were diluted to that concentration with the formulation buffer.

Example 2.4: Storage Stability Analysis Method

The antibodies and DVD-Ig molecule solutions prepared according to Example 2.3 were analyzed for their physical stability during storage at 40° C., 25° C., and/or 5° C. Both 25° C. (room temperature) and 5° C. (storage temperature) are typical temperatures at which the samples would be subjected either during preparation and storage for manufacture or as part of the final drug product presentation. Storage at 40° C. is considered an accelerated stability condition which provides an indication of long-term stability prospects. The samples were aliquoted into low volume containers (<0.1 ml), tightly sealed, and placed at the designated temperatures (sometimes in a water bath). The samples were then pulled at periodic intervals and a small portion was removed for analysis by SEC (Example 2.1).

Example 2.5: Freeze-Thaw Analysis Method

The antibody and DVD-Ig molecule solutions prepared according to Example 2.3 were analyzed for their physical stability during freeze/thaw stress. Samples were aliquoted into low volume containers (<1 ml) and tightly sealed. The samples were then placed at −80° C. for at least 6 hours and then thawed at 30° C. in a water bath. This was repeated three more times. After the second and fourth thaws, a small portion of each sample was removed for analysis by SEC (Example 2.1).

DVD-Ig solutions are typically frozen at −80° C. for long term storage as well as shipping to remote manufacturing sites. The samples are then thawed in order to complete the drug product manufacturing process. Stability due to freeze-thawing was assessed at low concentration in order to evaluate greater exposure of protein molecules to the denaturing ice-water interfaces. At higher concentrations, proportionally less protein encounters the ice-water interface, instead interacting with other protein molecules.

Example 2.6: Viscosity Determination Method

The antibody and DVD-Ig molecule solutions prepared according to Example 2.3 were analyzed for their viscosity at room temperature (~23° C.) with a Malvern Viscosizer 200 instrument. The viscosity serves as an indication of the ease of delivery of the sample through a small diameter needle attached to a syringe, a likely drug product presentation. A higher viscosity requires a greater force for delivery, and vice-versa.

Example 2.7: Intact and Reduced Molecular Weight Determination

The intact molecular weights of the three samples shown in Table 8 were acquired. Each sample was diluted to 1 mg/mL with Milli-Q water. 1.0 µL of the 1 mg/mL sample was injected onto an Agilent 6510 Q-Tof LC/MS system with a C4 MicroTrap column. Table 9 shows the HPLC gradient for intact molecular weight analysis. Buffer A was 0.02% TFA, 0.08% FA in water. Buffer B was 0.02% TFA, 0.08% FA in acetonitrile. The flow rate was 50 µL/minute. The column temperature was set at 60° C. The mass spectrometer was operated at 5 kvolts spray voltage and the scan range was from 600 to 3200 mass to charge ratio. The deglycosylated intact molecular weights of all three samples were measured by Agilent 6510 Q-Tof LC/MS system after the samples were deglycosylated. 100 µL of 1 mg/mL sample was mixed with 5 µL of 10% N-octylglucoside and 2 µL of PNGase F enzyme. The sample was incubated at 37° C. for 18 hours. 1.0 µg of the deglycosylated sample was injected onto an Agilent 6510 Q-Tof LC/MS system with a C4 MicroTrap for deglycosylated intact molecular weight analysis.

The reduced molecular weights of all three samples were obtained. Each sample was diluted to 1 mg/mL with Milli-Q water. 1.0 µL of 1M DTT was added to 100 µL of a 1 mg/mL sample and incubated at 37° C. for 30 minutes. 2.0 µL of the reduced sample was injected onto an Agilent 6510 Q-Tof LC/MS system with a diphenyl column. The HPLC gradient for reduced molecular weight analysis is shown in Table 9. The mass spectrometer was operated at 5 kvolts spray voltage and the scan range was from 600 to 3200 mass to charge ratio.

Q-Tof LC/MS system with a diphenyl column and a reduced HPLC gradient was used. The column temperature was set at 60° C. The mass spectrometer was operated at 5 kvolts spray voltage and the scan range was from 600 to 3200 mass to charge ratio.

Example 2.9: Charge Heterogeneity by Weak Cation Exchange Chromatography and Imaged Isoelectric Focusing (icIEF)

Charge heterogeneity was studied using a Propac WCX-10 column for weak cation exchange chromatography analysis. Mobile phase A was 20 mM MES, pH 5.5. Mobile phase B was 20 mM MES, 500 mM NaCl, pH 5.5. Each sample was diluted to 1 mg/mL in mobile phase A. 50 µg of each sample was loaded, and the HPLC gradient is shown in Table 10. The flow rate was 1 mL/minute flow rate and the UV detector was monitored at 280 nm.

TABLE 8

VEGF/PDGF DVD-Ig Formulations

| Sample ID | Lot | Detailed name | Concentration (mg/mL) | Formulation |
|---|---|---|---|---|
| PR-1572102 | Lot 2211502 | hu VEGF 4G8.3-GS-hu PDGF 9E8.4 (germline) [hu IgG1/k] LALA H435A | 6.5 | 30 mM histidine, 8% sucrose pH 5.2 |
| PR-1572105 | Lot 2211597 | hu VEGF 4G8.3-SL-hu PDGF 9E8.4 (germline) [hu IgG1/k] LALA H435A | 1.5 | 30 mM Histidine, 8% Sucrose pH 5.2 |
| PR-1610561 | Lot 2213329 | hu VEGF 9E10.1-GS-hu PDGF 33675 [hu IgG1/k] LALA H435A | 5 | 30 mM Histidine, 8% sucrose, pH 5.2 |

TABLE 9

PLC Operating Conditions For Intact And Reduced Molecular Weight

| Intact/C4 | | Reduced/Diphenyl | |
|---|---|---|---|
| Time (min) | % Buffer B | Time (min) | % Buffer B |
| 0 | 5 | 0 | 5 |
| 5 | 5 | 5 | 30 |
| 5.5 | 95 | 30 | 40 |
| 10 | 95 | 32 | 90 |
| 10.5 | 5 | 37 | 90 |
| 15 | 5 | 39 | 5 |
|  |  | 44 | 5 |

Example 2.8: Oligosaccharide Profiles Determined by Fc Molecular Weight Measurement Samples were partially digested with Lys-C enzyme, reduced and analyzed by LC/MS. Different oligosaccharide species were quantitated based on the peak intensity detected by mass spectrometry and the relative percentage of different oligosaccharide species was reported. Samples were diluted to 1 mg/mL with Milli-Q water. 100 µL of each sample was mixed with 2 µL of 0.005 mg/mL Lys-C enzyme and incubated at 37° C. for 30 minutes. 1 µL of 1 M DTT was added and incubated at 37° C. for 30 minutes for reduction. 2 µL of sample was injected onto an Agilent 6510

TABLE 10

Gradient Used For Weak Cation Exchange Chromatography

| Time (minutes) | Mobile phase B |
|---|---|
| 0 | 20 |
| 5 | 20 |
| 25 | 40 |
| 27 | 100 |
| 32 | 100 |
| 34 | 20 |
| 38 | 20 |

Imaged isoelectric focusing was performed on an iCE instrument from ProteinSimple. All three samples were diluted to 1 mg/mL with Milli-Q water before mixing with amphalyte and other components as shown in Table 11. Each sample was vortexed briefly and centrifuged for 5 minutes at 10 k RPM before being transferred to glass inserts for analysis. Each sample was pre-focused at 1500 V for 1 minute and focused at 3000 V for 8 minutes.

TABLE 11

Sample Preparation for icIEF

| Component | Volume (µL) |
|---|---|
| 1% Methyl cellulose | 70 |
| Pharmalyte 3-10 | 4 |
| Pharmalyte 5-8 | 4 |
| Diluted pI 5.1 marker | 8 |
| Diluted pI 8.2 marker | 8 |

TABLE 11-continued

Sample Preparation for icIEF

| Component | Volume (µL) |
|---|---|
| 1 mg/mL test sample | 50 |
| Water | 6 |
| 8M Urea | 50 |

Example 3: Generation of Rat Anti-VEGF-A, Anti-VEGFRII, Rat-Anti-PDGF-BB, Anti-PDGFR-B Monoclonal Antibodies by DNA Immunization and Rat Hybridoma Technology Example 3.1: DNA Immunization, Hybridoma Fusion and Screening Genetic immunization enables the development of antibodies against any protein target directly from a cDNA. A cDNA encoding the soluble human VEGFA-165, soluble human PDGF-BB, human VEGFR-II ECD (extracellular domain) or human PDGFR-BB ECD was cloned into a eukaryotic expression vector (Aldevron GmbH, Freiburg, Germany). Wistar rats were immunized by intradermal application of DNA-coated gold-particles using a hand-held device for particle-bombardment ("gene gun"). Antibody-producing splenocytes or lymph node cells were isolated and fused with fusion partner myeloma cells using polyethylene glycol (PEG) according to standard procedures. To help identify positive antisera and hybridomas, screening is done with the use of either cells transfected with screening vector encoding GPI anchored human VEGF-A165, human PDGF-BB, human VEGFR-II ECD or human PDGFR-BB ECD proteins, soluble recombinant human VEGF-A165 and human PDGF-BB protein or peptides. The tables below are the lists of antibodies generated using the rat DNA immunization approach.

Anti-VEGF-A antibodies derived from rat hybridomas were characterized for binding, function and cross-reactivity in a panel of assays. Supernatants were tested for the ability to bind $hVEGF_{165}$ (Example 1.3) and block binding of $hVEGF_{165}$ to hVEGFR2 in a competition ELISA format (Example 1.4). Select hybridomas were assessed for cross-reactivity by testing for the ability to block human $VEGF_{111}$ and rabbit $VEGF_{165}$ in a Tyr1054 phosphorylation assay (Example 1.6) and blocking of murine $VEGF_{164}$ binding to mVEGFR2 (Example 1.5). Candidate rat IgG was then examined for potency in the $hVEGF_{165}$-induced cell proliferation assay (Example 1.7), reactivity to native $hVEGF_{165}$ (Example 1.11) and binding affinity measurement by Biacore analysis (Example 1.1). The data is summarized in Tables 12 and 13 below.

TABLE 12

A List of Anti-VEGF-A Antibodies Generated Using DNA Immunization and Rat Hybridoma Technology

| Hybridoma Clones | Isotype | ELISA huVEGF-A 165 Binding | ELISA huVEGF-$A_{121}$ Binding | Phospho-Tyr1054/ huVEGF-$A_{111}$ Neutralization | ELISA Binding to Naturally Derived huVEGF-A | Receptor Competition ELISA huVEGF-$A_{165}$/ huVEGF-R2 (nM) | huVEGF-$A_{165}$ Neutralization Potency in hVEGF-R2 Over-expressing Cells (nM) | ELISA Mouse VEGF-$A_{164}$ Binding | ELISA Rat VEGF-$A_{164}$ Binding | Phospho-Tyr1054/ Rabbit VEGF-$A_{165}$ Neutralization |
|---|---|---|---|---|---|---|---|---|---|---|
| BEW-164-C4 | IgG2b/κ | + | NT | + | + | 0.18 | 0.09 | − | NT | + |
| BEW-1E3-D6 | IgG2b/κ | + | NT | + | + | 0.62 | 0.39 | − | NT | + |
| BEW-5C3-E7 | IgG2b/κ | + | NT | + | + | 0.156 | 0.88 | − | NT | + |
| BEW-6C2-C8 | IgG2b/κ | + | NT | + | + | 0.197 | <0.1 | − | NT | + |
| BEW-8E6-E4 | IgG2a/κ | + | NT | + | + | 0.342 | 0.41 | − | NT | + |
| BEW-9A8-E2 | IgG2a/κ | + | NT | + | + | 0.249 | 0.16 | − | NT | + |
| BEW-9E10-E7 | IgG2a/κ | + | NT | + | + | 0.274 | 0.17 | − | NT | + |
| BEW-10H2-B9 | IgG2b/κ | + | NT | + | + | 0.42 | 0.42 | − | NT | + |
| BEW-9E3--B9 | IgG2a/κ | + | NT | + | + | 0.124 | <0.1 | − | NT | + |
| BEW-9E7-B4 | IgG2b/κ | + | NT | + | + | 0.207 | 0.14 | − | NT | + |
| BEW-1G1-C2 | IgG1/κ | + | NT | + | + | 0.584 | 1.46 | − | NT | + |

TABLE 12-continued

A List of Anti-VEGF-A Antibodies Generated Using DNA Immunization and Rat Hybridoma Technology

| Hybridoma Clones | Isotype | ELISA huVEGF-A 165 Binding | ELISA huVEGF-$A_{121}$ Binding | Phospho-Tyr1054/ huVEGF-$A_{111}$ Neutralization | ELISA Binding to Naturally Derived huVEGF-A | Receptor Competition ELISA huVEGF-$A_{165}$/ huVEGF-R2 (nM) | huVEGF-$A_{165}$ Neutralization Potency in hVEGF-R2 Over-expressing Cells (nM) | ELISA Mouse VEGF-$A_{164}$ Binding | ELISA Rat VEGF-$A_{164}$ Binding | Phospho-Tyr1054/ Rabbit VEGF-$A_{165}$ Neutralization |
|---|---|---|---|---|---|---|---|---|---|---|
| BEW-9C2-D6 | IgG2b/κ | + | NT | + | + | 0.155 | <0.1 | − | NT | + |
| BEW-9D2-E8 | IgG2a/κ | + | NT | + | + | 0.127 | 0.09 | − | NT | + |
| BEW-1B10-B9-C3 | IgG2a/κ | + | NT | + | + | 0.326 | 2.8 | − | NT | + |
| BEW-3A1-D10-G9 | IgG2b/κ | + | NT | + | + | 0.124 | 0.96 | − | NT | + |
| BED-4G10-C8 | IgG2b/κ | + | NT | + | + | 0.13 | 0.38 | − | NT | + |
| BDB-4G8-D4 | IgG2b/κ | + | NT | + | + | 0.13 | 0.617 | − | NT | + |

NT = not tested

TABLE 13

Biacore Binding of Rat Anti-VEGF Antibodies

| Antibody | $k_{on}$ (M−1 s−1) | $k_{off}$ (M−1) | $K_D$ (M) |
|---|---|---|---|
| BDB-4G8-D4 | ≥1.0E+07 | 8.1E−06 | ≤8.1E−13 |
| BDB-4G8-D4 | 1.4E+07 | 1.6E−05 | 1.2E−12 |
| BED-4G10-C8 | 1.8E+07 | 1.1E−03 | 6.0E−11 |
| BEW-1B4-C4 | 1.8E+07 | 1.3E−04 | 7.4E−12 |
| BEW-1B10-B9-C3 | 4.4E+06 | 7.2E−05 | 1.6E−11 |
| BEW-1E3-D6 | 1.4E+07 | 1.4E−04 | 1.0E−11 |
| BEW-1G1-C2 | 1.6E+07 | 3.0E−04 | 1.9E−11 |
| BEW-3A1-D10-G9 | 1.0E+07 | 1.4E−03 | 1.4E−10 |
| BEW-5C3-E7 | 1.2E+07 | 4.8E−05 | 3.9E−12 |
| BEW-6C2-C8 | 6.9E+06 | 8.4E−05 | 1.2E−11 |
| BEW-8E6-E4 | 6.9E+06 | 1.2E−04 | 1.7E−11 |
| BEW-9A8-E2 | 7.4E+06 | 7.1E−06 | 9.6E−13 |
| BEW-9C2-D6 | 5.5E+06 | ≤1.0E−06 | ≤1.8E−13 |
| BEW-9D2-E8 | 7.0E+06 | 9.8E−05 | 1.4E−11 |
| BEW-9E10-E7 | 1.3E+07 | 3.9E−05 | 3.1E−12 |
| BEW-9E3-B9 | 6.7E+06 | 9.5E−05 | 1.4E−11 |
| BEW-9E7-B4 | 5.9E+06 | 2.5E−05 | 4.3E−12 |
| BEW-10H2-B9 | 2.4E+07 | 2.7E−04 | 1.1E−11 |

Anti-PDGF-BB antibodies derived from rat hybridomas were characterized for binding, function and cross-reactivity in a panel of assays. Supernatants were tested for the ability to bind hPDGF-BB (Example 1.12) and block binding of hPDGF-BB to hPDGF-R in a competition ELISA format (Example 1.13). Select hybridomas were assessed for the ability to block human and rat PDGF-BB in a Tyr751 phosphorylation assay (Example 1.14). Candidate rat IgG was then examined for potency in the human, mouse and cynomolgus PDGF-BB-induced cell proliferation assay (Examples 1.15-1.17), reactivity to native hPDGF-BB (Example 1.19) and binding affinity measurement by Biacore analysis (Example 1.1). The data is summarized in Tables 14 and 15 below.

TABLE 14

A List of Anti-PDGF-BB Antibodies Generated using DNA Immunization and Rat Hybridoma Technology

| Hybridoma Clones | Isotype | ELISA huPDGF-BB Binding | ELISA Binding to Naturally Derived huPDGF-BB | Receptor Competition ELISA huPDGF-BB/ huPDGF Rβ (nM) | Phospho-Tyr751/hPDGF-BB Neutralization (nM) | huPDGF-BB Neutralization Potency (nM) in NIH-3T3 Cells | Phospho-Tyr751/ ratPDGF-BB Neutralization (nM) | mPDGF-BB Neutralization Potency (nM) in NIH-3T3 Cells | cynoPDGF-BB Neutralization Potency (nM) in NIH-3T3 Cells |
|---|---|---|---|---|---|---|---|---|---|
| BDI-9E8-E7 | IgG2b/κ | + | + | 1.121 | 0.629 | 0.195 | 0.333 | 0.026 | 0.194 |
| BDI-5H1-F6 | IgG2b/κ | + | + | 0.528 | 0.884 | 0.371 | 0.319 | NT | NT |

TABLE 14-continued

A List of Anti-PDGF-BB Antibodies Generated using DNA Immunization and Rat Hybridoma Technology

| Hybridoma Clones | Isotype | ELISA huPDGF-BB Binding | ELISA Binding to Naturally Derived huPDGF-BB | Receptor Competition ELISA huPDGF-BB/ huPDGF Rβ (nM) | Phospho-Tyr751/hPDGF-BB Neutralization (nM) | huPDGF-BB Neutralization Potency (nM) in NIH-3T3 Cells | Phospho-Tyr751/ ratPDGF-BB Neutralization (nM) | mPDGF-BB Neutralization Potency (nM) in NIH-3T3 Cells | cynoPDGF-BB Neutralization Potency (nM) in NIH-3T3 Cells |
|---|---|---|---|---|---|---|---|---|---|
| BDI-7H10-D8 | IgG2b | + | + | >10 | >10 | >5 | >5 | NT | NT |
| BDI-1E1-D5 | IgG2b/κ | + | NT | >10 | 1.057 | >5 | + | NT | NT |
| BDI-5G2-F9 | IgG2b/λ | + | NT | 1.065 | 0.923 | 0.741 | + | NT | NT |
| BDI-6A3-A9 | IgG2b/λ | + | NT | 3.228 | 1.618 | >5 | − | NT | NT |
| BDI-7F6-D3 | IgG2b | + | NT | >10 | >10 | >5 | − | NT | NT |
| BDI-10E7-F9 | IgG2b/λ | + | NT | 1.035 | 2.53 | >5 | − | NT | NT |
| BDI-8B8-F2 | IgG2b/λ | + | NT | 1.086 | 3.159 | >5 | − | NT | NT |
| BFF-5C9-C7-B5 | IgG2b/κ | + | NT | >50 | 0.753 | >5 | NT | NT | NT |
| BFF-7D7-D3-E4 | IgG2b/λ | + | NT | >50 | 1.745 | >10 | NT | NT | NT |
| BFF-7E9-C3-B6 | IgG2b/κ | + | NT | >50 | >10 | >10 | NT | NT | NT |
| BFF-4G8-B4 | IgG2b/λ | + | NT | >50 | 1.896 | >10 | NT | NT | NT |
| BFF-4E8-E5 | IgG2b/λ | + | NT | >50 | 0.739 | >10 | NT | NT | NT |
| BFU-3E2-B9-B8 | IgG2b/κ | + | NT | >50 | 0.642 | 0.247 | NT | NT | NT |
| BFU-11A8-D6-C3 | IgG2b/κ | + | NT | 7.095 | 0.736 | 0.344 | NT | NT | NT |
| BFU-3H6-D2 | IgG2b | + | NT | 2.287 | 0.639 | >10 | NT | NT | NT |

TABLE 15

Biacore Binding of Rat Anti-PDGF Antibodies

| Antibody | $k_{on}$ (M−1 s−1) | $k_{off}$ (M−1) | $K_D$ (M) |
|---|---|---|---|
| BDI-1E1-D5 | ≥1.0E+07 | 3.7E−04** | ≤3.7E−11** |
| BDI-5G2-F9 | ≥1.0E+07 | ≤1.0E−06 | ≤1.0E−13 |
| BDI-5H1-F6 | ≥1.0E+07 | ≤1.0E−06 | ≤1.0E−13 |
| BDI-6A3-A9 | ≥1.0E+07 | 6.7E−03** | ≤6.7E−10** |
| BDI-7F6-D3 | ≥1.0E+07 | 6.0E−03 | ≤6.0E−10 |
| BDI-7H10-D8 | ≥1.0E+07 | ≤1.3E−02** | ≤1.3E−09** |
| BDI-8B8-F2 | ≥1.0E+07* | ≤1.0E−06* | ≤1.0E−13* |
| BDI-9E8-E7 | ≥1.7E+07 | ≤1.0E−06 | ≤5.8E−14 |
| BDI-9E8-E7 | ≥1.0E+07 | ≤1.0E−06 | ≤1.0E−13 |
| BDI-10E7-F9 | ≥1.0E+07* | 1.3E−04* | ≤1.3E−11* |
| BFF-4E8-E5 | ≥1.0E+07 | 8.3E−03*** | ≤8.3E−10*** |
| BFF-4G4-B8 | ≥1.0E+07 | 8.3E−03** | ≤8.3E−10** |
| BFF-5C9-C7-B5 | ≥1.0E+07 | 5.8E−05 | ≤5.8E−12 |
| BFF-7D7-D3-E4 | ≥1.0E+07 | 2.1E−02** | ≤2.1E−09** |
| BFF-7E9-C3-B6 | ≥1.0E+07 | 1.2E−03** | ≤1.2E−10** |
| BFU-3E2-B9-B8 | ≥1.0E+07 | 1.5E−06 | ≤1.5E−13 |
| BFU-3H6-D2 | ≥1.0E+07 | 2.7E−04** | ≤2.7E−11** |
| BFU-11A8-D6-C3 | 2.1E+07 | ≤1.0E−06 | ≤4.7E−14 |

*Low Ag response
**Heterogeneous off-rate
***Low Ag response and Heterogeneous off-rate Anti-VEGFR2 antibodies derived from rat hybridomas were characterized for binding, function and cross-reactivity in a panel of assays. The subcloned rat antibodies were tested for the ability to bind hVEGFR2 (Example 1.22), block binding of hVEGF-R2 to hVEGF$_{165}$ in a competition ELISA format (Example 1.23), and a hVEGF$_{165}$ Tyr1054 phosphorylation assay (Example 1.24). Candidate molecules were then characterized for species cross-reactivity by testing their ability to block binding of mVEGFR2 to mVEGF$_{164}$ in a competition ELISA format (Example 1.25). The data is summarized in Table 16 below.

TABLE 16

A List of Anti-VEGFR II Antibodies Generated Using
DNA Immunization and Rat Hybridoma Technology

| Hybridoma Clones | Isotype | hVEGFR2-Fc Binding | Potency (nM) hVEGF$_{165}$/hVEGFR2-Fc Competition | mVEGF$_{164}$/mVEGFR2-Fc Competition | Tyr1054 phospho-assay |
|---|---|---|---|---|---|
| BCU-3D6-C9 |  | + | NT | NT | NT |
| BCU-6B1-G6 | IgG2a/κ | + | 4.850 | 1.350 | + |
| BCU-7A6-C2 | IgG2b/κ | + | − | − | + |

Anti-PDGF-Rβ antibodies derived from rat hybridomas were characterized for binding and function in a panel of assays. The subcloned rat antibodies were tested for the ability to bind hPDGF-Rβ (Example 1.26). Candidate IgG was also characterized for the ability to block binding of hPDGF-Rβ to hPDGF-BB in a competition ELISA format (Example 1.27) and an hPDGF-BB Tyr751 phosphorylation assay (Example 1.28). The data is summarized in Table 17 below.

TABLE 17

A List of Anti-PDGFR-B Antibodies Generated Using
DNA Immunization and Rat Hybridoma Technology

| Hybridoma Clones | Isotype | hPDGFRβ-Fc Binding | Potency (nM) hPDGF-BB/hPDGFRβ-Fc Competition | hPDGF-BB/Tyr751 phospho-assay |
|---|---|---|---|---|
| BDE-3C9-G4 | IgG2b/κ | + | 0.832 | 4.696 |
| BDE-4F2-D4 | IgG2a/κ | + | 0.527 | + |
| BDE-8H6-F7 |  | + | + | − |

Example 4: Deduction of Variable Region Protein Sequences of Monoclonal Antibodies by DNA Cloning and Sequencing Total RNA was extracted from hybridoma cell pellets using RNeasy mini kit (Qiagen, catalog #74104) using the following protocol. 600 µl of buffer RLT were added to disrupt cells by pipetting up and down several times. The cell lysate was homogenized by passing it 10 times through a 20-gauge needle fitted to an RNase-free syringe. One volume of 70% ethanol was added to the homogenized lysate and mixed well by pipetting. Up to 700 µl at a time of the sample were added to an RNeasy spin column and spun for 15 seconds at 10,000 rpm, discarding flow through. 700 µl of buffer RW1 were added to the column and spun for 15 seconds at 10,000 rpm, discarding flow through. 500 µl of buffer RPE were added to wash the column membrane and spun for 15 seconds at 10,000 rpm, discarding flow through. The same step was repeated one more time, but the column was centrifuged for 2 minutes. Sample was then centrifuged for 1 minute at 10,000 rpm to eliminate any carryover of buffer RPE. RNA was eluted with 30 µl of RNase-free water by centrifuging for 1 minute at 10,000 rpm. Subsequently, 2 µg of total RNA were used to synthesize first-strand cDNA using SuperScript First-Strand Synthesis System for RT-PCR (Invitrogen, catalog #11904-018) according to following protocol: 2 tag of RNA+2 µl dNTP+2 µl Oligo (dT)+DEPC-H$_2$O (to 20 µl) were incubated at 65° C. for 5 minutes, then transferred to ice for at least 1 minute. The sample was then added to the following mixture: 4 µl of 10×RT buffer+8 µl 25 mM MgCl$_2$+4 µl 0.1 M DTT+2 µl RNase OUT and incubated at 42° C. for 2 minutes. Then, 2 µl of SuperScript II RT were added to the sample and incubated at 42° C. for 50 minutes. Sample was then incubated at 70° C. for 15 minutes and chilled on ice. 2 µl of RNase H were then added and the sample was incubated at 37° C. for 20 minutes. cDNA was then used as template for PCR amplification of variable regions of antibodies. PCR was performed using first-strand cDNA, primers from Mouse Ig-Primer Set (Novagen, catalog #69831-3) and Platinum Super Mix High Fidelity (Invitrogen, catalog #12532-016). To amplify heavy chain variable regions, PCR samples were assembled as follows: 22.5 µl PCR Super Mix+0.25 µl reverse primer MuIgG V$_H$3'-2+1 µl cDNA+1.25 µl of one the forward primers (VH-A, VH-B) or 0.5 µl of one of the forward primers (VH-C, VH-D, VH-E, VH-F). To amplify light chain variable regions, PCR samples were assembled as follows: 22.5 µl PCR Super Mix+0.25 µl reverse primer MuIgKV$_L$-3'-1+1 µl cDNA+1.25 µl of one the forward primers (VL-A, VL-B) or 0.5 µl of one of the forward primers (VL-C, VL-D, VL-E, VL-F, VL-G).

For samples with primers VH-A, VH-B, VL-A and VL-B, the following PCR cycles were used (40-45 cycles, steps 2 through 4):

1—Denature 94° C. 2 minutes.
2—Denature 94° C. 30 seconds.
3—Anneal 50° C. 30 seconds.
4—Extend 68° C. 1 minute.
5—Final extension 68° C. 5 minutes.
6—Cool 4° C. forever For samples with primers VH-C through VH-F, and VL-C through VL-G, the following PCR cycles were used (40-45 cycles, steps 2 through 4):

1—Denature 94° C. 2 minutes.
2—Denature 94° ° C. 30 seconds.
3—Anneal 60° C. 30 seconds.
4—Extend 68° C. 1 minute.
5—Final extension 68° C. 5 minutes.
6—Cool 4° C. forever PCR products were run on a 1.2% agarose gel, and bands migrating at the expected size (400-500 bp) were excised for DNA extraction. DNA was purified using QIAquick Gel Extraction Kit (Qiagen, catalog #28704) according to the following protocol: gel slices were weighed. 3 volumes of buffer QG to 1 volume of gel were added to each gel slice. Samples were incubated at 50° C. for 10 minutes until gel slices were completely dissolved, mixing every 2-3 minutes. One gel volume of isopropanol was then added to each sample and mixed. Samples were then applied to QIAquick column and centrifuged for 1 minute at 13000 rpm. To wash, 750 µl of buffer PE were added to samples and spun for 1 minute at 13000 rpm. Columns were then centrifuged for an additional minute at 13,000 rpm to completely remove residual ethanol DNA was eluted by adding 30 µl of H$_2$O to each column and by spinning 1 minute at 13,000 rpm. Purified PCR products were then sequenced to identify variable region sequences (see Tables below).

TABLE 18

VH and VL Amino Acid Sequences of Rat
Anti-Human VEGFA Monoclonal Antibodies

| SEQ ID NO: | Clone | Protein Region | V Region 12345678901234567890123456 7 |
|---|---|---|---|
| 406 | BDB-4G8-D4 | VH | QIQLVQSGPELKKPGESVKISCKASGYTFTNYGMYW VKQAPGQGLQYMGWINTETGKPTYADDFKGRFVFFL ETSASTAYLQINNLKNEDMATYFCARTNYYYRSYIF YFDYWGQGTMVTVSS |
| 407 | BDB-4G8-D4 | CDR-H1 | GYTFTNYGMY |
| 408 | BDB-4G8-D4 | CDR-H2 | WINTETGKPTYADDFKG |
| 409 | BDB-4G8-D4 | CDR-H3 | TNYYYRSYIFYFDY |
| 410 | BDB-4G8-D4 | VL | DTVLTQSPALAVSPGERVSISCRASESVSTHMHWYQ QKPGQQPKLLIYGASNLESGVPARFSGSGSGTDFTL TIDPVEADDTATYFCQQSWNDPFTFGAVTKLELK |
| 411 | BDB-4G8-D4 | CDR-L1 | RASESVSTHMH |
| 412 | BDB-4G8-D4 | CDR-L2 | GASNLES |
| 413 | BDB-4G8-D4 | CDR-L3 | QQSWNDPFT |
| 414 | BED-4G10-C8 | VH | QVQLQQSGTELVKPGSSVKISCKASGYTFTSNYMHW IRQQPGNGLEWIGWIYPGDGDTNYNHNFNGKATLTA DKSSSTAYMQLSSLTSEDFAVYFCASSTRAIPGWFT YWGQGTLVTVSS |
| 415 | BED-4G10-C8 | CDR-H1 | GYTFTSNYMH |
| 416 | BED-4G10-C8 | CDR-H2 | WIYPGDGDTNYNHNFNG |
| 417 | BED-4G10-C8 | CDR-H3 | STRAIPGWFTY |
| 418 | BED-4G10-C8 | VL | DTVLTQSPALAVSPGERVSISCWASESVSTLMHWYQ QKLGQQPKLLIYGASNLESGVPARFRGSGSGTDFTL TIDPVEADDTATYFCQQSWSDPYTFGAGTKLELK |
| 419 | BED-4G10-C8 | CDR-L1 | WASESVSTLMH |
| 420 | BED-4G10-C8 | CDR-L2 | GASNLES |
| 421 | BED-4G10-C8 | CDR-L3 | QQSWSDPYT |
| 422 | BEW-10H2-B9 | VH | QIQLVQSGPELKKPGESVKISCKASGYSFTNFGLYW VKQAPGQGLQYMGWIDTETGKPTYADDFRGRFVFFL ETSASTAYLQINNLKNEDMATYFCARVYGYPSWYFD FWGPGTMVTVSS |
| 423 | BEW-10H2-B9 | CDR-H1 | GYSFTNFGLY |
| 424 | BEW-10H2-B9 | CDR-H2 | WIDTETGKPTYADDFRG |
| 425 | BEW-10H2-B9 | CDR-H3 | VYGYPSWYFDF |
| 426 | BEW-10H2-B9 | VL | DIQMTQSPASLSTSLEEIVTITCQASQDIDNYLSWY QQKPGKSPQLLIHSATSLADGVPSRFSGSRSGTQFS LKIHRLQVEDTGIYYCLQHFFPPWTFGGGTKLELK |
| 427 | BEW-10H2-B9 | CDR-L1 | QASQDIDNYLS |
| 428 | BEW-10H2-B9 | CDR-L2 | SATSLAD |
| 429 | BEW-10H2-B9 | CDR-L3 | LQHFFPPWT |
| 430 | BEW-1B10-B9-C3 | VH | EVQLVESGGGLVQPGRSLKLSCAASGFSFSKYDMAW FRQTPTKGLEWVASITTSGVGTYYRDSVKGRFTVSR DNAKSTLYLQMDSLRSEDTATYYCARGYGAMDAWGQ GTSVTVSS |
| 431 | BEW-1B10-B9-C3 | CDR-H1 | GFSFSKYDMA |
| 432 | BEW-1B10-B9-C3 | CDR-H2 | SITTSGVGTYYRDSVKG |
| 433 | BEW-1B10-B9-C3 | CDR-H3 | GYGAMDA |

TABLE 18-continued

VH and VL Amino Acid Sequences of Rat
Anti-Human VEGFA Monoclonal Antibodies

| SEQ ID NO: | Clone | Protein Region | V Region 12345678901234567890 1234567 |
|---|---|---|---|
| 434 | BEW-1B10-B9-C3 | VL | DIQMTQSPASLSASLEEIVTITCKASQDIDDYLSWYQQKPGKSPQLVIYAATRLADGVPSRFSGSGSGTQYSLKISRLQVDDSGIYYCLQSSSTPWTFGGGTNLELK |
| 435 | BEW-1B10-B9-C3 | CDR-L1 | KASQDIDDYLS |
| 436 | BEW-1B10-B9-C3 | CDR-L2 | AATRLAD |
| 437 | BEW-1B10-B9-C3 | CDR-L3 | LQSSSTPWT |
| 438 | BEW-1B4-C4 | VH | QIQLVQSGPELKKPGESVKISCKASGYSFTNYGMYWVKQAPGQGLQYMGWIDTETGKPTYTDDFKGRFVFFLETSASTAYLQINNLKNEDMATYFCARWSGDTAGIRGPWFAYWGQGTLVTVSS |
| 439 | BEW-1B4-C4 | CDR-H1 | GYSFTNYGMY |
| 440 | BEW-1B4-C4 | CDR-H2 | WIDTETGKPTYTDDFKG |
| 441 | BEW-1B4-C4 | CDR-H3 | WSGDTAGIRGPWFAY |
| 442 | BEW-1B4-C4 | VL | DIRMTQSPASLSASLGETVNIECLASEDIYSDLAWYQQKPGKSPQLLIYNANDLQKGVPSRFSGSGSGTQYSLKINSLQSEDVATYFCQQYNYYPGTFGAGTKLELK |
| 443 | BEW-1B4-C4 | CDR-L1 | LASEDIYSDLA |
| 444 | BEW-1B4-C4 | CDR-L2 | NANDLQK |
| 445 | BEW-1B4-C4 | CDR-L3 | QQYNYYPGT |
| 446 | BEW-1C6-D2 | VH | QIQLVQSGPELKKPGESVKISCKASGYTFTNYGMYWVKQAPGQGLQYMGWINTETGKPTYADDFKGRFVFFLETSASTAYFQINNLKNEDLATYFCARPSDYYDGFWFPYWGQGTLVTVSS |
| 447 | BEW-1C6-D2 | CDR-H1 | GYTFTNYGMY |
| 448 | BEW-1C6-D2 | CDR-H2 | WINTETGKPTYADDFKG |
| 449 | BEW-1C6-D2 | CDR-H3 | PSDYYDGFWFPY |
| 450 | BEW-1C6-D2 | VL | DTALTQSPALAVSPGERVSISCRASEGVNSYMHWYQQSPGQQPKLLIYKASNLASGVPARFSGSGSGTDFTLTIDPVEADDTATYFCQQSWYDPLTFGSGTKLEIK |
| 451 | BEW-1C6-D2 | CDR-L1 | RASEGVNSYMH |
| 452 | BEW-1C6-D2 | CDR-L2 | KASNLAS |
| 453 | BEW-1C6-D2 | CDR-L3 | QQSWYDPLT |
| 454 | BEW-1E3-D6 | VH | QIQLVQSGPELKKPGESVKISCKASGYPFTNSGMYWVKQAPGQGLQYMGWINTEAGKPTYADDFKGRFVFFLETSASTAYLQINNLKNEDMATYFCARWGYISDNSYGWFDYWGQGTLVTVSS |
| 455 | BEW-1E3-D6 | CDR-H1 | GYPFTNSGMY |
| 456 | BEW-1E3-D6 | CDR-H2 | WINTEAGKPTYADDFKG |
| 457 | BEW-1E3-D6 | CDR-H3 | WGYISDNSYGWFDY |
| 458 | BEW-1E3-D6 | VL | DTVLTQSPALAVSPGERVSISCRASEGVYSYMHWYQQNPGQQPKLLIYKASNLASGVPARFSGSGSGTDFTLTIDPVEADDTATYFCHQNWNDPLTFGSGTKLEIK |
| 459 | BEW-1E3-D6 | CDR-L1 | RASEGVYSYMH |
| 460 | BEW-1E3-D6 | CDR-L2 | KASNLAS |
| 461 | BEW-1E3-D6 | CDR-L3 | HQNWNDPLT |

TABLE 18-continued

VH and VL Amino Acid Sequences of Rat
Anti-Human VEGFA Monoclonal Antibodies

| SEQ ID NO: | Clone | Protein Region | V Region 12345678901234567890123456 |
|---|---|---|---|
| 462 | BEW-3A1-D10-G9 | VH | QVQLEQSGAELVKPGTSVKLSCMASGYTSSSNHMNW MKQTTGQGLEWIGIINPGSGGTRYNVKFEGKATLTV DKSSSTAFMQLNSLTPEDSAVYYCARAGFPGPFSYY AMGAWGQGTSVTVSS |
| 463 | BEW-3A1-D10-G9 | CDR-H1 | GYTSSSNHMN |
| 464 | BEW-3A1-D10-G9 | CDR-H2 | IINPGSGGTRYNVKFEG |
| 465 | BEW-3A1-D10-G9 | CDR-H3 | AGFPGPFSYYAMGA |
| 466 | BEW-3A1-D10-G9 | VL | DIQMTQSPPVLSASVGDRVTLSCKASQNIHNNLDWY QQKHGEAPKLLIFYTNNLQTGIPSRFSGSGSGTDYT LTISSLQPEDVATYYCYQYNSGYTFGAGTKLELK |
| 467 | BEW-3A1-D10-G9 | CDR-L1 | KASQNIHNNLD |
| 468 | BEW-3A1-D10-G9 | CDR-L2 | YTNNLQT |
| 469 | BEW-3A1-D10-G9 | CDR-L3 | YQYNSGYT |
| 470 | BEW-5C3-E7 | VH | QIQLVQSGPELKKPGESVKISCKASGYTFTNYGVYW VKQAPGQGLQYMGWINTETGKPTYADDFKGRFVFFL ETSTNTAYLQINNLKNEDMATFFCARARQLDWFVYW GQGTLVTVSS |
| 471 | BEW-5C3-E7 | CDR-H1 | GYTFTNYGVY |
| 472 | BEW-5C3-E7 | CDR-H2 | WINTETGKPTYADDFKG |
| 473 | BEW-5C3-E7 | CDR-H3 | ARQLDWFVY |
| 474 | BEW-5C3-E7 | VL | DTVLTQSPALTVSPGERVSISCRARESLTTSLCWFQ QKPGQQPKLLIYGASKLESGVPARFSGSGSGTDFTL TIDPVEADDTATYFCQQSWYDPPTFGGGTKLELK |
| 475 | BEW-5C3-E7 | CDR-L1 | RARESLTTSLC |
| 476 | BEW-5C3-E7 | CDR-L2 | GASKLES |
| 477 | BEW-5C3-E7 | CDR-L3 | QQSWYDPPT |
| 478 | BEW-6C2-C8 | VH | EVQLVESGGGLVQPGSSLKLSCAASGFTFSYYGMHW IRQAPKKGLEWMALIYYDSSKMYYADSVKGRFTISR DNSKNTLYLEMNSLRSEDTAMYYCAAGGTAPVYWGQ GVMVTVSS |
| 479 | BEW-6C2-C8 | CDR-H1 | GFTFSYYGMH |
| 480 | BEW-6C2-C8 | CDR-H2 | LIYYDSSKMYYADSVKG |
| 481 | BEW-6C2-C8 | CDR-H3 | GGTAPVY |
| 482 | BEW-6C2-C8 | VL | NIQLTQSPSLLSASVGDRVTLSCKGSQNIANYLAWY QQKLGEAPKLLIYNTDSLQTGIPSRFSGSGSGTDYT LTISSLQPEDVATYFCYQSNNGYTFGAGTKLELR |
| 483 | BEW-6C2-C8 | CDR-L1 | KGSQNIANYLA |
| 484 | BEW-6C2-C8 | CDR-L2 | NTDSLQT |
| 485 | BEW-6C2-C8 | CDR-L3 | YQSNNGYT |
| 486 | BEW-8E6-E4 | VH | QIQLVQSGPELKKPGESVKISCKASGYTFTDYAMHW VKQAPGKVLKWMGWINTFTGKPTYIDDFKGRFVFSL EASASTANLQISDLKNEDTATYFCARGNYYSGYWYF DFWGPGTMVTMSS |
| 487 | BEW-8E6-E4 | CDR-H1 | GYTFTDYAMH |
| 488 | BEW-8E6-E4 | CDR-H2 | WINTFTGKPTYIDDFKG |
| 489 | BEW-8E6-E4 | CDR-H3 | GNYYSGYWYFDF |

TABLE 18-continued

VH and VL Amino Acid Sequences of Rat
Anti-Human VEGFA Monoclonal Antibodies

| SEQ ID NO: | Clone | Protein Region | V Region 12345678901234567890123456 |
|---|---|---|---|
| 490 | BEW-8E6-E4 | VL | DIQMTQSPASLSASLGETISIECRASEDISSNLAWY QQKSGKSPQLLIFAANRLQDGVPSRFSGSGSGTQFS LKISGMQPEDEGDYFCLQGSKFYTFGAGTKLELK |
| 491 | BEW-8E6-E4 | CDR-L1 | RASEDISSNLA |
| 492 | BEW-8E6-E4 | CDR-L2 | AANRLQD |
| 493 | BEW-8E6-E4 | CDR-L3 | LQGSKFYT |
| 494 | BEW-9A8-E2 | VH | QIQLVQSGPELKKPGESVKISCKASGYTFTNYGMYW VKQAPGQGLQYMGWINTETGKPIYADDFKGRFVFFL ETSASTAYLQINNLKNEDMATFFCARVDYDGSFWFA YWGQGTLVTVSS |
| 495 | BEW-9A8-E2 | CDR-H1 | GYTFTNYGMY |
| 496 | BEW-9A8-E2 | CDR-H2 | WINTETGKPIYADDFKG |
| 497 | BEW-9A8-E2 | CDR-H3 | VDYDGSFWFAY |
| 498 | BEW-9A8-E2 | VL | DTVLTQSPALAVSPGERVSISCRASESVSTVIHWYQ QKPGQQPKLLIHGASNLESGVPARFSGSGSGTDFTL TIDPVEADDTATYFCQQHWNDPPTFGAGTKLEMK |
| 499 | BEW-9A8-E2 | CDR-L1 | RASESVSTVIH |
| 500 | BEW-9A8-E2 | CDR-L2 | GASNLES |
| 501 | BEW-9A8-E2 | CDR-L3 | QQHWNDPPT |
| 502 | BEW-9C2-D6 | VH | QIQLVQSGPELKKPGESVKVSCKASGYTFTNYGIHW VKQAPGQGLQYVGWINTETGRPTYADDFKGRFVFFL ETSASTAYLQINNLKNEDMATYFCARPLYYGYAHYF DYWGQGVMVTVSS |
| 503 | BEW-9C2-D6 | CDR-H1 | GYTFTNYGIH |
| 504 | BEW-9C2-D6 | CDR-H2 | WINTETGRPTYADDFKG |
| 505 | BEW-9C2-D6 | CDR-H3 | PLYYGYAHYFDY |
| 506 | BEW-9C2-D6 | VL | DIQMTQSPASLSASLEEIVTITCQASQDIGNWLAWY QQKPGKSPQLLIYGATSLADGVPSRFSGSRSGTQYS LKISRLQVEDIGIYYCQQASSVTYTFGAGTKLELK |
| 507 | BEW-9C2-D6 | CDR-L1 | QASQDIGNWLA |
| 508 | BEW-9C2-D6 | CDR-L2 | GATSLAD |
| 509 | BEW-9C2-D6 | CDR-L3 | QQASSVTYT |
| 510 | BEW-9D2-E8 | VH | QIQLVQSGPELKKPGESVKISCKASGYTFTNYGMYW VKLAPGQGLQYLGWINTETGKPTYADDFKGRFVFFL ETSASTAYLQINNLRNEDMATYFCARPSDYYDGFWF AYWGQGTLVTVSS |
| 511 | BEW-9D2-E8 | CDR-H1 | GYTFTNYGMY |
| 512 | BEW-9D2-E8 | CDR-H2 | WINTETGKPTYADDFKG |
| 513 | BEW-9D2-E8 | CDR-H3 | PSDYYDGFWFAY |
| 514 | BEW-9D2-E8 | VL | DTVLTQSPALTVSPGERVSISCRASEWVNSYMHWYQ QNPGQQPKLLIYKASNLASGVPARFSGSGSGTDFTL TLDPVEADDTATYFCQQSWNDPLTFGSGTKLEIK |
| 515 | BEW-9D2-E8 | CDR-L1 | RASEWVNSYMH |
| 516 | BEW-9D2-E8 | CDR-L2 | KASNLAS |
| 517 | BEW-9D2-E8 | CDR-L3 | QQSWNDPLT |

TABLE 18-continued

VH and VL Amino Acid Sequences of Rat
Anti-Human VEGFA Monoclonal Antibodies

| SEQ ID NO: | Clone | Protein Region | V Region 12345678901234567890123456 7 |
|---|---|---|---|
| 518 | BEW-9E10-E7 | VH | QIQLLQSGPELKKPGESVKISCKASGYTFTNYGMYW VKQAPGQGLQYMGWIDTETGRPTYADDFKGRFVFFL ETSASTAYLQINNLKNEDMATYFCARWSGDTTGIRG PWFAYWGQGTLVTVSS |
| 519 | BEW-9E10-E7 | CDR-H1 | GYTFTNYGMY |
| 520 | BEW-9E10-E7 | CDR-H2 | WIDTETGRPTYADDFKG |
| 521 | BEW-9E10-E7 | CDR-H3 | WSGDTTGIRGPWFAY |
| 522 | BEW-9E10-E7 | VL | DIRMTQSPASLSASLGETVNIECLASEDIYSDLAWY QQKPGRSPQLLIYNANGLQNGVPSRFGGSGSGTQYS LKINSLQSEDVATYFCQQYNYFPGTFGAGTKLELK |
| 523 | BEW-9E10-E7 | CDR-L1 | LASEDIYSDLA |
| 524 | BEW-9E10-E7 | CDR-L2 | NANGLQN |
| 525 | BEW-9E10-E7 | CDR-L3 | QQYNYFPGT |
| 526 | BEW-9E3-B9 | VH | QIQLVQSGPELKKPGESVKISCKASGYTFTNYGMYW VKQAPGQGLQYMGWINTETGKPTYADDFKGRFVFFL ETSASTAFLQINNLKNEDMATYFCARPSDYYDGFWF PYWGQGALVTVSS |
| 527 | BEW-9E3-B9 | CDR-H1 | GYTFTNYGMY |
| 528 | BEW-9E3-B9 | CDR-H2 | WINTETGKPTYADDFKG |
| 529 | BEW-9E3-B9 | CDR-H3 | PSDYYDGFWFPY |
| 530 | BEW-9E3-B9 | VL | DTILTQSPALAVSPGERISISCRASEGVNSYMHWYQ QNPGQQPKLLIYKASNLASGVPARFSGSGSGTDFTL TIDPVEADDTATYFCQQSWNDPLTFGSGTKLEIK |
| 531 | BEW-9E3-B9 | CDR-L1 | RASEGVNSYMH |
| 532 | BEW-9E3-B9 | CDR-L2 | KASNLAS |
| 533 | BEW-9E3-B9 | CDR-L3 | QQSWNDPLT |
| 534 | BEW-9E7-B4 | VH | QIQLVQSGPELKKPGESVKISCKASGYTFTNYGMYW VKQAPGQGLQYMGWIDTETGKPTYADDFKGRFVFFL ETSASTAYLQINNLRNEDMATYFCARWGYTSDYYYG WFPDWGQGTLVTVST |
| 535 | BEW-9E7-B4 | CDR-H1 | GYTFTNYGMY |
| 536 | BEW-9E7-B4 | CDR-H2 | WIDTETGKPTYADDFKG |
| 537 | BEW-9E7-B4 | CDR-H3 | WGYTSDYYYGWFPD |
| 538 | BEW-9E7-B4 | VL | DTVLTQSPALAVSPGERVSISCRASEGVNSYMHWYQ QNPGQQPKLLIYKASNLASGVPARFSGSGSGTDFTL NIHPVEADDTATYFCQQNWNVPLTFGSGTKLEIK |
| 539 | BEW-9E7-B4 | CDR-L1 | RASEGVNSYMH |
| 540 | BEW-9E7-B4 | CDR-L2 | KASNLAS |
| 541 | BEW-9E7-B4 | CDR-L3 | QQNWNVPLT |

TABLE 19

VH and VL Amino Acid Sequences of Rat Anti-Human PDGF-BB Monoclonal Antibodies

| SEQ ID NO: | Clone | Protein Region | V Region 12345678901234567890123456 |
|---|---|---|---|
| 542 | BDI-1E1-D5 | VH | EVKLQQSGDELVRPGASVKMSCKASGYTFTDYVMHW VKQSPGQGLEWIGTIIPLIDTTSYNQKFKGKATLTA DKSSNTAYMELSRLTSEDSAVYYCARTSPYYYSSYD VMDAWGQGASVTVSS |
| 543 | BDI-1E1-D5 | CDR-H1 | GYTFTDYVMH |
| 544 | BDI-1E1-D5 | CDR-H2 | TIIPLIDTTSYNQKFKG |
| 545 | BDI-1E1-D5 | CDR-H3 | TSPYYYSSYDVMDA |
| 546 | BDI-1E1-D5 | VL | NIQLTQSPSLLSASVGDRVTLSCKGSQNINNYLAWY QQKLGEAPKLLIYKTNNLQTGIPSRFSGCGSGTDYT LTISSLHSEDLATYYCYQYDNGYTFGAGTKLELK |
| 547 | BDI-1E1-D5 | CDR-L1 | KGSQNINNYLA |
| 548 | BDI-1E1-D5 | CDR-L2 | KTNNLQT |
| 549 | BDI-1E1-D5 | CDR-L3 | YQYDNGYT |
| 550 | BDI-5G2-F9 | VH | QVTLKESGPGILQPSQTLSLTCTFSGFSLSTFGMGV GWIRQPSGKGLEWLANIWWDDDKYYNPSLKNRLTIS KDTSNSQAFLEITNVDTADTATYYCARISTGISSYY VMDAWGQGASVTVSS |
| 551 | BDI-5G2-F9 | CDR-H1 | GFSLSTFGMGVG |
| 552 | BDI-5G2-F9 | CDR-H2 | NIWWDDDKYYNPSLKN |
| 553 | BDI-5G2-F9 | CDR-H3 | ISTGISSYYVMDA |
| 554 | BDI-5G2-F9 | VL | QFTLTQPKSVSGSLRSTITIPCERSSGDIGDTYVSW YQQHLGRPPINVIYGNDQRPSEVSDRFSGSIDSSSN SASLTITNLQMDDEADYFCQSYDSDIDIVFGGGTKL TVL |
| 555 | BDI-5G2-F9 | CDR-L1 | ERSSGDIGDTYVS |
| 556 | BDI-5G2-F9 | CDR-L2 | GNDQRPS |
| 557 | BDI-5G2-F9 | CDR-L3 | QSYDSDIDIV |
| 558 | BDI-5H1-F6 | VH | QVTLKESGPGILQPSQTLSLTCTFSGFSLSTFGMGV GWIRQPSGKGLEWLANIWWDDDKYYNPSLKNRLTIS KDTSNSQAFLEITNVDTADTATYYCARISTGISSYY VMDAWGQGASVTVSS |
| 559 | BDI-5H1-F6 | CDR-H1 | GFSLSTFGMGVG |
| 560 | BDI-5H1-F6 | CDR-H2 | NIWWDDDKYYNPSLKN |
| 561 | BDI-5H1-F6 | CDR-H3 | ISTGISSYYVMDA |
| 562 | BDI-5H1-F6 | VL | QFTLTQPKSVSGSLRSTITIPCERSSGDIGDTYVSW YQQHLGRPPINVIYGNDQRPSEVSDRFSGSIDSSSN SASLTITNLQMDDEADYFCQSYDSDIDIVFGGGTKL TVL |
| 563 | BDI-5H1-F6 | CDR-L1 | ERSSGDIGDTYVS |
| 564 | BDI-5H1-F6 | CDR-L2 | GNDQRPS |
| 565 | BDI-5H1-F6 | CDR-L3 | QSYDSDIDIV |
| 566 | BDI-6A3-A9 | VH | EVQLVESGGGLVQPGRSLKFSCAASGFSFSDSAMAW VRQAPKKGLEWVATIIYDGSGTYYRDSVKGRFTISR DNAKSTLYLQMDSLRSEDTATYYCARLGFNYGNYGY YVMDAWGQGASVTVSS |
| 567 | BDI-6A3-A9 | CDR-H1 | GFSFSDSAMA |
| 568 | BDI-6A3-A9 | CDR-H2 | TIIYDGSGTYYRDSVKG |

TABLE 19-continued

VH and VL Amino Acid Sequences of Rat Anti-Human PDGF-BB Monoclonal Antibodies

| SEQ ID NO: | Clone | Protein Region | V Region 12345678901234567890123456 |
|---|---|---|---|
| 569 | BDI-6A3-A9 | CDR-H3 | LGFNYGNYGYYVMDA |
| 570 | BDI-6A3-A9 VL | | QFTLTQPKSVSGSLRNTITIPCERSSGDIGDSYVSW YQQHLGRPPINVIFADDQRPSEVSDRFSGSIDSSSN SASLTITNLQMDDEADYFCQSYDSNIDINIVFGGGT KLTVL |
| 571 | BDI-6A3-A9 | CDR-L1 | ERSSGDIGDSYVS |
| 572 | BDI-6A3-A9 | CDR-L2 | ADDQRPS |
| 573 | BDI-6A3-A9 | CDR-L3 | QSYDSNIDINIV |
| 574 | BDI-7H10-D8 VH | | EVKLQQSGDELVRPGASVKMSCKASGYTFTDYAMHW VKQSPGQGLEWIGTIIPLIDTTSYNQKFKGKATLTA DTSSNTAYMELSRLTSEDSAVYYCARDWDNNWGYFD YWGQGVMVTVSS |
| 575 | BDI-7H10-D8 | CDR-H1 | GYTFTDYAMH |
| 576 | BDI-7H10-D8 | CDR-H2 | TIIPLIDTTSYNQKFKG |
| 577 | BDI-7H10-D8 | CDR-H3 | DWDNNWGYFDY |
| 578 | BDI-7H10-D8 VL | | DVVLTQTPVSLSVTLGDQASISCRSSQSLEYSDGYT YLEWYLQKPGQSPQLLIYGVSNRFSGVPDRFIGSGS GTDFTLKISRVEPEDLGVYYCFQATHDPLTFGSGTK LEIK |
| 579 | BDI-7H10-D8 | CDR-L1 | RSSQSLEYSDGYTYLE |
| 580 | BDI-7H10-D8 | CDR-L2 | GVSNRFS |
| 581 | BDI-7H10-D8 | CDR-L3 | FQATHDPLT |
| 582 | BDI-9E8-E7 VH | | QVTLKESGPGILQPSQTLSLTCTFSGFSLSTYGMGV GWIRQPSGKGLEWLANIWWDDDKYYNPSLKNRLTIS KDTSNNQAFLKITNVDTADTATYYCARIESIGTTYS FDYWGQGVMVTVSS |
| 583 | BDI-9E8-E7 | CDR-H1 | GFSLSTYGMGVG |
| 584 | BDI-9E8-E7 | CDR-H2 | NIWWDDDKYYNPSLKN |
| 585 | BDI-9E8-E7 | CDR-H3 | IESIGTTYSFDY |
| 586 | BDI-9E8-E7 VL | | QFTLTQPKSVSGSLRSTITIPCERSSGDIGDSYVSW YQQHLGRPPINVIYADDQRPSEVSDRFSGSIDSSSN SASLTITNLQMDDEADYFCQSYDINIDIVFGGGTKL TVL |
| 587 | BDI-9E8-E7 | CDR-L1 | ERSSGDIGDSYVS |
| 588 | BDI-9E8-E7 | CDR-L2 | ADDQRPS |
| 589 | BDI-9E8-E7 | CDR-L3 | QSYDINIDIV |
| 590 | BFU-11A8-D6-C3 VH | | EVQLQQSGPELQRPGASVKLSCKASGYTFTESYIYW VKQRPEQSLELIGRIDPEDGSTDYVEKFKNKATLTA DTSSNTAYMQLSSLTSEDTATYFCARFGARSYFYPM DAWGQGTSVTVSS |
| 591 | BFU-11A8-D6-C3 | CDR-H1 | GYTFTESYIY |
| 592 | BFU-11A8-D6-C3 | CDR-H2 | RIDPEDGSTDYVEKFKN |
| 593 | BFU-11A8-D6-C3 | CDR-H3 | FGARSYFYPMDA |
| 594 | BFU-11A8-D6-C3 VL | | DTVLTQSPTLAVSPGERVSIPCRASESVSTLMHWYQ QKPGQQPRLLIYGASNLESGVPARFSGSGSGTDFTL TIDPVEADDTATYFCQQSWNDPWTFGGGTKLELK |
| 595 | BFU-11A8-D6-C3 | CDR-L1 | RASESVSTLMH |

TABLE 19-continued

VH and VL Amino Acid Sequences of Rat Anti-Human PDGF-BB Monoclonal Antibodies

| SEQ ID NO: | Clone | Protein Region | V Region 12345678901234567890123456 |
|---|---|---|---|
| 596 | BFU-11A8-D6-C3 | CDR-L2 | GASNLES |
| 597 | BFU-11A8-D6-C3 | CDR-L3 | QQSWNDPWT |
| 598 | BFU-3E2-B9-B8 | VH | EVQLQQSGPELQRPGASVKLSCKASGYTFTESYMYW VKQRPEQSLELIGRIDPEDGSTDYVEKFKNKATLTA DTSSNTAYMQLSSLTSEDSATYFCARFGARSYFYPM DAWGQGTSVTVSS |
| 599 | BFU-3E2-B9-B8 | CDR-H1 | GYTFTESYMY |
| 600 | BFU-3E2-B9-B8 | CDR-H2 | RIDPEDGSTDYVEKFKN |
| 601 | BFU-3E2-B9-B8 | CDR-H3 | FGARSYFYPMDA |
| 602 | BFU-3E2-B9-B8 | VL | DTVLTQPPALAVSPGERVSISCRASESVSTLMHWYQ QKPGQQPRLLIYGASNLESGVPARFSGSGSGTDFTL TIDPVEADDTATYFCQQSWNDPWTFGGGTKLELK |
| 603 | BFU-3E2-B9-B8 | CDR-L1 | RASESVSTLMH |
| 604 | BFU-3E2-B9-B8 | CDR-L2 | GASNLES |
| 605 | BFU-3E2-B9-B8 | CDR-L3 | QQSWNDPWT |

TABLE 20

VH and VL Amino Acid Sequences of Rat Anti-Human VEGFR II Monoclonal Antibodies

| SEQ ID NO: | Clone | Protein Region | V Region 12345678901234567890123456 |
|---|---|---|---|
| 606 | BCU-3D6-C9 | VH | QIQLVQSGPELKKPGESVKISCKASEYTFTDYAIHW VKQAPGKGLKWMGWINTYTGKPTYADDFKGRFVFSL EASASTANLQISNLKNEDTATYFCARDYGGYGERRD YFDYWGQGVMVTVSS |
| 607 | BCU-3D6-C9 | CDR-H1 | EYTFTDYAIH |
| 608 | BCU-3D6-C9 | CDR-H2 | WINTYTGKPTYADDFKG |
| 609 | BCU-3D6-C9 | CDR-H3 | DYGGYGERRDYFDY |
| 610 | BCU-3D6-C9 | VL | DIQMTQSPASLSASLGETVTIECRVSEDIYNGLAWY QQKPGKSPQFLIYNANRLHTGVPSRFSGSGSGTQFS LKINSLQSEDVANYFCQQYYDYPLTFGSATKLEIK |
| 611 | BCU-3D6-C9 | CDR-L1 | RVSEDIYNGLA |
| 612 | BCU-3D6-C9 | CDR-L2 | NANRLHT |
| 613 | BCU-3D6-C9 | CDR-L3 | QQYYDYPLT |
| 614 | BCU-6B1-G6 | VH | QIQLVQSGPELKKPGESVKISCKASGYTFTNYGMYW VKQAPGQALQFMGWINTETGQPTYADDFKGRFVFFL ETSASTAYLQINNLKNEDMATYFCARLGNNYGIWFA YWGQGTLVTVSS |
| 615 | BCU-6B1-G6 | CDR-H1 | GYTFTNYGMY |
| 616 | BCU-6B1-G6 | CDR-H2 | WINTETGQPTYADDFKG |
| 617 | BCU-6B1-G6 | CDR-H3 | LGNNYGIWFAY |
| 618 | BCU-6B1-G6 | VL | DIQMTQSPASLSASLGETVTIECRASDDLYSTLAWY QQKPGDSPQLLIFDANRLAAGVPSRFSGSGSGTQYS LKINSLQSEDVASYFCQQYNKFPWTFGGGTKLELK |
| 619 | BCU-6B1-G6 | CDR-L1 | RASDDLYSTLA |

TABLE 20-continued

VH and VL Amino Acid Sequences of Rat Anti-Human VEGFR II Monoclonal Antibodies

| SEQ ID NO: | Clone | Protein Region | V Region 1234567890123456789 0123456 |
|---|---|---|---|
| 620 | BCU-6B1-G6 | CDR-L2 | DANRLAA |
| 621 | BCU-6B1-G6 | CDR-L3 | QQYNKFPWT |
| 622 | BCU-7A6-C2 | VH | EVQLVESGGGLVQPRGSLKLSCAASGFDFNSYGMSW VRQAPGKGLDLVADISSKSYNYATYYADSVKDRFTI SRDDSQSMVYLQMDNLKTEDTALYYCTESLELGGAY WGQGTLVTVSS |
| 623 | BCU-7A6-C2 | CDR-H1 | GFDFNSYGMS |
| 624 | BCU-7A6-C2 | CDR-H2 | DISSKSYNYATYYADSVKD |
| 625 | BCU-7A6-C2 | CDR-H3 | SLELGGAY |
| 626 | BCU-7A6-C2 | VL | DIQMTQSPPSLSASLGDEVTITCQASQNINKFIAWY QQKPGKAPRLLIRYTSTLKSGTPSRFSGSGSGRDYS FSISNVESEDIASYYCLQYDSLPWTFGGGTKLELK |
| 627 | BCU-7A6-C2 | CDR-L1 | QASQNINKFIA |
| 628 | BCU-7A6-C2 | CDR-L2 | YTSTLKS |
| 629 | BCU-7A6-C2 | CDR-L3 | LQYDSLPWT |

TABLE 21

VH and VL Amino Acid Sequences of Rat Anti-Human PDGFR-B Monoclonal Antibodies

| SEQ ID NO: | Clone | Protein Region | V Region 1234567890123456789 0123456 |
|---|---|---|---|
| 630 | BDE-3C9-G4 | VH | EVQLVESGGGLVQPGRSLKLSCAASGFTFSNYGMA WVRQAPTQGLEWVASITNSGGNTYYRDSVKGRFTI SRDSAKNTQYLQMDSLRSEDTATYFCARHTPGANY FDYWGQGLMVTVSS |
| 631 | BDE-3C9-G4 | CDR-H1 | GFTFSNYGMA |
| 632 | BDE-3C9-G4 | CDR-H2 | SITNSGGNTYYRDSVKG |
| 633 | BDE-3C9-G4 | CDR-H3 | HTPGANYFDY |
| 634 | BDE-3C9-G4 | VL | DIQMTQSPPSLSASLGEKVTITCQASQSIKNYIAW YQLKPGTAPRLLMRYTSTLESGTPSRFSGSGSGRD YSFSISNVESEDIASYYCVQYANLYTFGGGTKLEL K |
| 635 | BDE-3C9-G4 | CDR-L1 | QASQSIKNYIA |
| 636 | BDE-3C9-G4 | CDR-L2 | YTSTLES |
| 637 | BDE-3C9-G4 | CDR-L3 | VQYANLYT |
| 638 | BDE-4F2-D4 | VH | QVQLKESGPGLMQPSQTLSLTCTVSGFSLTNYGVS WVRQFPGKGLEWIAAISSGGSTYYNSALKSRLSIS RDTSRSQVFLKMNSLLTEDTAFYFCTRVYYGSNYF DYWGPGVMVTVSS |
| 639 | BDE-4F2-D4 | CDR-H1 | GFSLTNYGVS |
| 640 | BDE-4F2-D4 | CDR-H2 | AISSGGSTYYNSALKS |
| 641 | BDE-4F2-D4 | CDR-H3 | VYYGSNYFDY |
| 642 | BDE-4F2-D4 | VL | DIVMTQTPSSQAVSAGEKVTMSCKSSQSLLYGGDQ KNFLAWYQQKPGQSPKLLIYLASTRESGVPDRFIG SGSGTDFTLTISSVQAEDLADYYCQQHYGYPFTFG SGTKLEIK |

TABLE 21-continued

VH and VL Amino Acid Sequences of Rat Anti-Human PDGFR-B Monoclonal Antibodies

| SEQ ID NO: | Clone | Protein Region | V Region 1234567890123456789 0123456 |
|---|---|---|---|
| 643 | BDE-4F2-D4 | CDR-L1 | KSSQSLLYGGDQKNFLA |
| 644 | BDE-4F2-D4 | CDR-L2 | LASTRES |
| 645 | BDE-4F2-D4 | CDR-L3 | QQHYGYPFT |
| 646 | BDE-8H6-F7 | VH | EVQLVESGGGLVQPGSSLKLSCLASGFTFSNYNMY WIRQAPKKGLEWIALIFYDNNNKYYADSVKGRFTI SRDNSKNTLYLEMNSLRSEDTAMYYCLRDSGPFSY WGQGTLVTVSS |
| 647 | BDE-8H6-F7 | CDR-H1 | GFTFSNYNMY |
| 648 | BDE-8H6-F7 | CDR-H2 | LIFYDNNNKYYADSVKG |
| 649 | BDE-8H6-F7 | CDR-H3 | DSGPFSY |
| 650 | BDE-8H6-F7 | VL | DIQMTQSPPSLSASLGDKVTINCQAGQNIKKYIAW YQQEPGKVPRLLIRYTSKLESDTPSRFSGSGSGRD YSFSISNVESEDIASYYCLQYDNLPWTFGGGTKLE LK |
| 651 | BDE-8H6-F7 | CDR-L1 | QAGQNIKKYIA |
| 652 | BDE-8H6-F7 | CDR-L2 | YTSKLES |
| 653 | BDE-8H6-F7 | CDR-L3 | LQYDNLPWT |

Example 5: Generation of Chimeric Antibodies

The variable domains of the heavy and light chain of the rat mAbs were cloned in-frame to mutant human IgG1 (L234, 235A) heavy-chain and kappa light-chain constant regions, respectively. The activities of the resulting chimeric antibodies were confirmed in ELISA-based binding and competition assays or Biacore binding assay, and were comparable to their parental rat mAbs.

Chimeric anti-VEGF-A antibodies were characterized for binding, function and cross-reactivity in a panel of assays. Potency for all chimeric molecules was characterized in the hVEGF$_{165}$-induced cell proliferation assay (Example 1.7). Binding affinity of these molecules to hVEGF$_{165}$ was measured by Biacore analysis (Example 1.1). Select chimeric molecules were tested for the ability to block binding of hVEGF$_{165}$ to hVEGF-R2 in a competition ELISA format (Example 1.4) and a hVEGF$_{111}$ Tyr1054 phosphorylation assay (Example 1.6). Candidate molecules were then examined for potency in the HMVEC-d hVEGF$_{165}$-induced proliferation assay (Example 1.10) and species cross-reactivity in the rabVEGF$_{165}$-induced cell proliferation assay (Example 1.9). The data is summarized in Tables 22 and 23 below.

TABLE 22

Characterization of Chimeric Anti-Human VEGF-A Monoclonal Antibodies

| Chimeric Clones | ELISA huVEGF-A$_{165}$ Binding | Receptor Competition ELISA huVEGF-A$_{165}$/huVEGFR2 (nM) | Phospho-Tyr1054/huVEGF-A$_{111}$ Neuterlization (nM) | huVEGF-A$_{165}$ Neutralization Potency in hVEGFR2 Overexpressing Cells (nM) | rabbitVEGF-A$_{165}$ Neutralization Potency in hVEGFR2 Overexpressing Cells (nM) | huVEGF-A$_{165}$ Neutralization Potency in HMVEC-d cells (nM) |
|---|---|---|---|---|---|---|
| chBEW-1B4 | NT | NT | NT | 1.428 | NT | NT |
| chBEW-1B4 half-body | NT | NT | NT | 1.669 | NT | NT |
| chBEW-1E3 | NT | NT | NT | 0.657 | NT | NT |
| chBEW-1E3 half-body | NT | NT | NT | 3.752 | NT | NT |
| chBEW-5C3 | NT | NT | NT | 0.244 | NT | NT |
| chBEW-5C3 half-body | NT | NT | NT | 2.264 | NT | NT |
| chBEW-6C2 | NT | 0.148 | 0.435 | >10 | 0.58 | 0.031 |
| chBEW-6C2 half-body | NT | NT | NT | >10 | NT | NT |
| chBEW-8E6 | NT | NT | NT | 0.499 | NT | NT |
| chBEW-8E6 half-body | NT | NT | NT | >10 | NT | NT |
| chBEW-9A8 | NT | 0.097 | 0.260 | 0.416 | 0.510 | 0.026 |

TABLE 22-continued

Characterization of Chimeric Anti-Human VEGF-A Monoclonal Antibodies

| Chimeric Clones | ELISA huVEGF-$A_{165}$ Binding | Receptor Competition ELISA huVEGF-$A_{165}$/ huVEGFR2 (nM) | Phospho-Tyr1054/ huVEGF-$A_{111}$ Neuterlization (nM) | huVEGF-$A_{165}$ Neutralization Potency in hVEGFR2 Overexpressing Cells (nM) | rabbitVEGF-$A_{165}$ Neutralization Potency in hVEGFR2 Overexpressing Cells (nM) | huVEGF-$A_{165}$ Neutralization Potency in HMVEC-d cells (nM) |
|---|---|---|---|---|---|---|
| chBEW-9A82 half-body | NT | NT | NT | 1.584 | NT | NT |
| chBEW-9E10 | NT | NT | NT | 0.448 | NT | NT |
| chBEW-9E10 half-body | NT | NT | NT | 0.598 | NT | NT |
| chBEW-10H2 | NT | NT | NT | 0.912 | NT | NT |
| chBEW-10H2-B9 half-body | NT | NT | NT | 2.562 | NT | NT |
| chBEW-9C2 | NT | NT | NT | 2.090 | NT | NT |
| chBEW-9C2 half-body | NT | NT | NT | 2.740 | NT | NT |
| chBEW-9D2 | NT | NT | NT | 1.556 | 0.740 | 2.150 |
| chBEW-9D2 half-body | NT | NT | NT | >10 | NT | NT |
| chBEW-1B10 | NT | NT | NT | 0.377 | NT | NT |
| chBEW-3A1 | NT | NT | NT | 0.680 | NT | NT |
| chBEW-3A1 half-body | NT | NT | NT | >10 | NT | NT |
| chBDB-4G8 | NT | 0.157 | 0.575 | 0.687 | NT | 0.195 |
| chBEW-1C6 half-body | NT | NT | NT | 3.595 | NT | NT |

NT—Not tested

TABLE 23

Biacore Binding of Rat and Rat-Human Chimera Anti-VEGF

| Antibody | $k_{on}$ (M-1 s-1) | $k_{off}$ (M-1) | $K_D$ (M) |
|---|---|---|---|
| chBDB-4G8 | 1.7E+07 | 2.4E−05 | 1.9E−12 |
| chBDB-4G8 | 1.2E+07 | 4.7E−05 | 3.8E−12 |
| chBED-4G10-C8 | 1.0E+07 | 5.9E−03 | 5.9E−10 |
| chBEW-1B4-C4 | 1.1E+07 | 1.2E−04 | 1.1E−11 |
| chBEW-1B10-B9-C3 | 5.5E+06 | 5.2E−05 | 9.4E−12 |
| chBEW-1E3-D6 | 7.2E+06 | 8.0E−05 | 1.1E−11 |
| chBEW-3A1-D10-G9 | 3.5E+07 | 8.0E−04 | 2.3E−11 |
| chBEW-5C3-E7 | 6.8E+06 | 8.2E−05 | 1.2E−11 |
| chBEW-6C2 | 4.9E+06 | 4.3E−05 | 8.8E−12 |
| chBEW-8E6-E4 | 6.2E+06 | 1.0E−04 | 1.6E−11 |
| chBEW-9A8 | 8.9E+06 | ≤1.0E−06 | ≤1.1E−13 |
| chBEW-10H2-B9 | 2.8E+07 | 3.5E−04 | 1.3E−11 |

Chimeric anti-PDGF-BB antibodies were characterized for binding, function and cross-reactivity in a panel of assays. The chimeric molecules were first tested for the ability to bind hPDGF-BB in a direct binding ELISA (Example 1.12). Binding affinity of these molecules to hPDGF-BB was then measured by Biacore analysis (Example 1.1). Functional characterization of these molecules included testing of the ability to block binding of hPDGF-BB to hPDGF-Rβ in a competition ELISA format (Example 1.13) and an hPDGFRβ Tyr751 phosphorylation assay (Example 1.14). Potency was further characterized in the hPDGF-BB-induced cell proliferation assay (Example 1.15). Candidate molecules were advanced and cross-reactivity was determined for mouse and rat/rabbit PDGF-BB in the cell-based proliferation assay (Examples 1.17-1.18). The data is summarized in Tables 24 and 25 below.

TABLE 24

Characterization of Chimeric Anti-Human PDGF-BB Monoclonal Antibodies

| Chimeric Molecule | ELISA huPDGF-BB Binding | Receptor Competition ELISA huPDGF-BB/ huPDGFR | Phospho-Tyr751/hPDGF-BB Neutralization (nM) | huPDGF-BB Neutralization Potency (nM) in NIH-3T3 Cells | ratPDGF-BB Neutralization Potency (nM) in NIH-3T3 Cells B (nM) | mPDGF-BB Neutralization Potency (nM) in NIH-3T3 Cells |
|---|---|---|---|---|---|---|
| chBDI-9E8 | 0.38 | 0.791 | 0.388 | 0.058 | 0.075 | 0.08 |
| chBDI-9E8 half-body | NT | NT | NT | 1.84 | NT | NT |
| chBDI-5H1 | 0.12 | 1.039 | 1.602 | 0.275 | 0.17 | NT |
| chBDI-5H1 half-body | NT | NT | NT | >10 | NT | NT |
| chBDI-7H10 | >10 | 10.1 | 2.476 | >10 | NT | NT |
| chBDI-5G2 | NT | 1.08 | NT | 0.181 | 0.118 | NT |
| chBDI-1E1 | NT | 0.417 | NT | >5 | NT | NT |
| chBDI-1E1 half body | NT | NT | NT | >10 | NT | NT |
| chBDI-8B8 | NT | 0.179 | NT | >10 | NT | NT |

TABLE 24-continued

Characterization of Chimeric Anti-Human PDGF-BB Monoclonal Antibodies

| Chimeric Molecule | ELISA huPDGF-BB Binding | Receptor Competition ELISA huPDGF-BB/ huPDGFR | Phospho-Tyr751/hPDGF-BB Neutralization (nM) | huPDGF-BB Neutralization Potency (nM) in NIH-3T3 Cells | ratPDGF-BB Neutralization Potency (nM) in NIH-3T3 Cells B (nM) | mPDGF-BB Neutralization Potency (nM) in NIH-3T3 Cells |
|---|---|---|---|---|---|---|
| chBFU-3E2 | NT | NT | NT | 0.099 | NT | NT |
| chBFU-3E2 half-body | NT | NT | NT | 2.494 | NT | NT |
| chBFU-11A8 | NT | NT | NT | 0.086 | NT | NT |
| chBFU-11A8 half-body | NT | NT | NT | >10 | NT | NT |

NT—Not tested

TABLE 25

Biacore Binding Of Rat And Rat-Human Chimera Anti-PDGF

| Antibody | $k_{on}$ (M−1 s−1) | $k_{off}$ (M−1) | $K_D$ (M) |
|---|---|---|---|
| BFU-11A8-D6-C3 | 2.1E+07 | ≤1.0E−06 | ≤4.7E−14 |
| chBDI-5H1 | ≥1.0E+07 | 1.5E−04 | ≤1.5E−11 |
| chBDI-9E8 | ≥1.0E+07 | 1.2E−04 | ≤1.2E−11 |
| chBFU-3E2-B9-B8 | ≥1.0E+07 | 1.9E−04 | ≤1.9E−11 |
| chBFU-11A8-D6-C3 | ≥1.0E+07 | 1.5E−04 | ≤1.5E−11 |

Chimeric anti-VEGFR2 antibodies were tested for the ability to block binding of VEGFR2 to $hVEGF_{165}$ in a competition ELISA format, as described in Example 1.22. The data is summarized in Table 26.

TABLE 26

Characterization of Chimeric Anti-Human VEGFR II Monoclonal Antibodies

| Chimeric Molecules | $hVEGF_{165}$/hVEGFR2-Fc Competition |
|---|---|
| chBCU-6B1-G6 | 0.498 |
| chBCU-7A6-C2 | NT |

Example 6: Humanization of Rat Monoclonal Antibodies

Below are the humanization designs for the rat monoclonal antibodies, followed by summaries of amino acid sequences and characterization of selected humanized antibodies.

Example 6.1: Humanization of PDGF-BB Antibodies

Example 6.1.1: Humanization Method

Antibody humanization is achieved by grafting CDRs of the rodent antibody onto a "similar" human framework (acceptor) and incorporating minimal number of key framework residues (back-mutation) from the rodent antibody that are selected to maintain the original CDR conformation in order to minimize the immunogenicity while retaining the optimal antigen binding.

Example 6.1.2: Human Germline Sequence Selections for Constructing CDR-Grafted, Humanized PDGF Antibodies By applying the aforementioned method, the CDR sequences of VH and VL chains of monoclonal antibodies BDI-5H1-F6, BDI-9E8-E7, BDI-7H10-D8, BDI-1E1-D5, BDI-6A3-A9, BFU-3E2 and BFU-11A8 were grafted onto different human heavy and light chain acceptor sequences.

Example 6.1.2.1: BDI-5H1-F6

Based on the alignments with the VH and VL sequences of monoclonal antibody BDI-5H1-F6 of the present invention, the following known human sequences are selected:
 1. IGHV2-70*01 and IGHJ6*01 for constructing heavy chain acceptor sequences
 2. IGHV2-70*04 and IGHJ6*01 as alternative acceptor sequence for constructing heavy chain
 3. IGHV3-66*01 and IGHJ1*01 as alternative acceptor sequence for constructing heavy chain
 4. IGLV6-57*01 and IGJL2*01 for constructing light chain acceptor sequences
 5. IGKV3-20*01 and IGJK4*01 as alternative acceptor sequences for constructing light chain
 6. IGKV4-1*01 and IGJK4*01 as alternative acceptor sequences for constructing light chain
 7. IGKV1-39*01 and IGJK1*01 as alternative acceptor sequences for constructing light chain
 By grafting the corresponding VH and VL CDRs of BDI-5H1-F6 into said acceptor sequences, the CDR-grafted, humanized, and modified VH and VL sequences were prepared.

Example 6.1.2.2: BDI-9E8-E7

Based on the alignments with the VH and VL sequences of monoclonal antibody BDI-9E8-E7 of the present invention, the following known human sequences are selected:
 1. IGHV2-70*01 and IGHJ3*01 for constructing heavy chain acceptor sequences
 2. IGHV2-70*04 and IGHJ6*01 as alternative acceptor sequence for constructing heavy chain
 3. IGHV3-66*01 and IGHJ1*01 as alternative acceptor sequence for constructing heavy chain
 4. IGLV6-57*01 and IGJL2*01 for constructing light chain acceptor sequences
 5. IGKV3-20*01 and IGJK4*01 as alternative acceptor for constructing light chain sequences
 6. IGKV4-1*01 and IGJK4*01 as alternative acceptor sequences for constructing light chain
 7. IGKV1-39*01 and IGJK1*01 as alternative acceptor sequences for constructing light chain
 By grafting the corresponding VH and VL CDRs of BDI-9E8-E7 into said acceptor sequences, the CDR-grafted, humanized, and modified VH and VL sequences were prepared.

Example 6.1.2.3: BDI-7H10-D8

Based on the alignments with the VH and VL sequences of monoclonal antibody BDI-7H10-D8 of the present invention, the following known human sequences are selected:
1. IGHV1-69*01 and IGHJ3*01 for constructing heavy chain acceptor sequences
2. IGKV2-29*02 and IGK2*01 for constructing light chain acceptor sequences By grafting the corresponding VH and VL CDRs of BDI-7H10-D8 into said acceptor sequences, the CDR-grafted, humanized, and modified VH and VL sequences were prepared.

Example 6.1.2.4: BDI-1E1-D5

Based on the alignments with the VH and VL sequences of monoclonal antibody BDI-1E1-D5 of the present invention the following known human sequences are selected:
1. IGHV1-69*06 and IGHJ6*01 for constructing heavy chain acceptor sequences
2. IGKV1D-13*01 and IGKJ2*01 for constructing light chain acceptor sequences
3. IGKV3-11*01 and IGKJ2*01 as alternative acceptor sequence for constructing light chain By grafting the corresponding VH and VL CDRs of BDI-1E1-D5 into said acceptor sequences, the CDR-grafted, humanized, and modified VH and VL sequences were prepared.

Example 6.1.2.5: BDI-6A3-A9

Based on the alignments with the VH and VL sequences of monoclonal antibody BDI-6A3-A9 of the present invention the following known human sequences are selected:
1. IGHV3-7*01 and IGHJ6*01 for constructing heavy chain acceptor sequences
2. IGHV1-3*01 and IGHJ6*01 as alternative acceptor sequence for constructing heavy chain
3. IGLV6-57*01 and IGJL2*01 for constructing light chain acceptor sequences By grafting the corresponding VH and VL CDRs of BDI-6A3-A9 into said acceptor sequences, the CDR-grafted, humanized, and modified VH and VL sequences were prepared.

Example 6.1.2.6: BFU-3E2

Based on the alignments with the VH and VL sequences of monoclonal antibody BFU-3E2 of the present invention, the following known human sequences are selected:
1. IGHV1-69*01 and IGHJ6*01 for constructing heavy chain acceptor sequences
2. IGKV3-11*01 and IGKJ4*01 for constructing light chain acceptor sequences
3. IGKV1-13*01 and IGKJ4*01 as alternative acceptor sequence for constructing light chain By grafting the corresponding VH and VL CDRs of BFU-3E2 into said acceptor sequences, the CDR-grafted, humanized, and modified VH and VL sequences were prepared.

Example 6.1.2.7: BFU-11A8

Based on the alignments with the VH and VL sequences of monoclonal antibody BFU-11A8 of the present invention, the following known human sequences are selected:
1. IGHV1-69*01 and IGHJ6*01 for constructing heavy chain acceptor sequences
2. IGKV3-11*01 and IGKJ4*01 for constructing light chain acceptor sequences
3. IGKV1-5*01 and IGKJ4*01 as alternative acceptor sequence for constructing light chain By grafting the corresponding VH and VL CDRs of BFU-11A8 into said acceptor sequences, the CDR-grafted, humanized, and modified VH and VL sequences were prepared.

Example 6.1.3: Introducing Potential Framework Back-Mutations in CDR-Grafted Antibodies To generate humanized antibody with potential framework back-mutations, the mutations were identified and introduced into the CDR-grafted antibody sequences by de novo synthesis of the variable domain, or mutagenic oligonucleotide primers and polymerase chain reactions, or by methods well known in the art. Different combinations of back mutations and other mutations are constructed for each of the CDR-grafts as follows. Residue numbers for these mutations are based on the Kabat numbering system.

BDI-5H1-F6

When IGHV2-70*01 and IGHJ6*01 selected as BDI-5H1-F6 heavy chain acceptor sequences, one or more of the following residues could be back-mutated as follows: Q1→E, A44→G, K75→N, V78→A, M82→I with or without N65→T (CDR change).

When IGHV2-70*04 and IGHJ6*01 selected as BDI-5H1-F6 heavy chain acceptor sequences, one or more of the following residues could be back-mutated as follows: Q→1E, K5→R, K75→N, N76→S, V78→A and M82→I.

When IGHV3-66*01 and IGHJ1*01 selected as BDI-5H1-F6 heavy chain acceptor sequences, one or more of the following residues could be back-mutated as follows: A24→F, V37→I, V48→L, S49→A, F67→L, R71→K, N73→T, T77→Q, L78→A, and M82→I.

When IGLV6-57*01 and IGJL2*01 selected as BDI-5H1-F6 light chain acceptor sequences, one or more of the following residues could be back-mutated as follows: N1→Q, S22→P, S43→P, T464→N, G57→E, P59→S, and Y87→F.

When IGKV3-20*01 and IGJK4*01 selected as BDI-5H1-F6 light chain acceptor sequences, one or more of the following residues could be back-mutated as follows: I2→F, A43→P, L46→N, L47→V, I58→V, G66→I, G68→S, T69→N, F71→A, Y87→F and with or without two residues insertion D66a, S66b and deletion of T10.

When IGKV4-1*01 and IGJK4*01 selected as BDI-5H1-F6 light chain acceptor sequences, one or more of the following residues could be back-mutated as follows: I2→F, M4→L, L46→N, L47→V, T69→N, D70→S, F71→A, Y87→F.

When IGKV1-39*01 and IGJK1*01 selected as BDI-5H1-F6 light chain acceptor sequences, one or more of the following residues could be back-mutated as follows: I2→F, M4→L, L46→N, L47→V, T69→N, D70→S, F71→A, and Y87→F.

BDI-9E8-E7

When IGHV2-70*01 and IGHJ6*01 selected as BDI-9E8-E7 heavy chain acceptor sequences, one or more of following residues could be back-mutated as follows: Q1→E, A44→G, V78→A M82→I with or without N65→T (CDR change).

When IGHV2-70*04 and IGHJ6*01 selected as BDI-9E8-E7 heavy chain acceptor sequences, one or more of the following residues could be back-mutated as follows: Q1→E, K5→R, V78→A, and M82→I.

When IGHV3-66*01 and IGHJ1*01 selected as BDI-9E8-E7 heavy chain acceptor sequences, one or more of the following residues could be back-mutated as follows: A24→F, V37→I, V48→L, S49→A, F67→L, R71→K, N73→T, T77→Q, L78→A, and M82→I.

When IGLV6-57*01 and IGJL2*01 selected as BDI-9E8-E7 light chain acceptor sequences, one or more of the following residues could be back-mutated as follows: S43→P, T46→N and Y87→F.

When IGKV3-20*01 and IGJK4*01 selected as BDI-9E8-E7 light chain acceptor sequences, one or more of the following residues could be back-mutated as follows: I2→F, A43→P, L46→N, L47→V, I58→V, G66→I, T69→N, F71→A, Y87→F and W/WO two residues insertion (D66a, S66b) and deletion of T10.

When IGKV4-1*01 and IGJK4*01 selected as BDI-9E8-E7 light chain acceptor sequences, one or more of the following residues could be back mutated as follows: I2→F, M4→L, L46→N, L47→V, T69→N, D70→S, F71→A, T72→S, and Y87→F.

When IGKV1-39*01 and IGJK1*01 selected as BDI-9E8-E7 light chain acceptor sequences, one or more of the following residues could be back mutated as follows: I2→F, M4→L, L46→N, L47→V, T69→N, D70→S, F71→A, and T72→S.

BDI-7H10-D8

When IGHV1-69*01 and IGHJ3*01 selected as BDI-7H10-D8 heavy chain acceptor sequences, one or more of following residues could be back-mutated as follows: Q1→E, M48→I, V67→A, I69→L, E73→T, S76→N, with or without CDR changes Y27→G and T30→S.

When IGKV2-29*02 and IGKJ2*01 selected as BDI-7H10-D8 light chain acceptor sequences, one or more of following residues could be back-mutated as follows: I2→V and M4→L.

BDI-1E1-D5

When IGHV1-69*06 and IGHJ6*01 selected as BDI-1E1-D5 heavy chain acceptor sequence, one or more of the following residues could be back-mutated as follows: Q1→E M48→I, V67→A, I69→L and S76→N.

When IGKV1D-13*01 and IGKJ2*01 selected as BDI-1E1-D5 light chain acceptor sequences, one or more of the following residues could be back-mutated as follows: V58→I and F71→Y.

When IGKV3-11*01 and IGKJ2*01 selected as BDI-1E1-D5 light chain acceptor sequences, one or more of the following residues could be back-mutated as follows: F71→Y and V85→T.

BDI-6A3-A9

When IGHV3-7*01 and IGHJ6*01 selected as BDI-6A3-A9 heavy chain acceptor sequences, one or more of the following residues could be back-mutated as follows: S28→T, R60→V, N76→S.

When IGHV1-3*01 and IGHJ6*01 selected as BDI-6A3-A9 heavy chains acceptor sequences, one or more of following residues could be back-mutated as follows: Q1→E, R44→G, M48→V, G49→A, V67→F, T73→N, A78→L and M80→L.

When IGLV6-57*01 and IGJL2*01 selected as BDI-6A3-A9 light chain acceptor sequences, one or more of the following residues could be back-mutated as follows: S43→P, T46→N, Y49→F and Y87→F.

BFU-3E2

When IGHV1-69*01 and IGHJ6*01 selected as BFU-3E2 heavy chain acceptor sequences, one or more of the following residues could be back-mutated as follows: R38→K, G44→S, W47→L, M48→I, R66→K, V67→A, 169→L, S76→N, Y91→F.

When IGKV3-11*01 and IGKJ4*01 selected as BFU-3E2 light chain acceptor sequences, one or more of the following could be back-mutated as follows: I2→T, A43→Q, 158→V, Y87→F.

When IGKV1-13*01 and IGKJ4*01 selected as BFU-3E2 light chain acceptor sequences, one or more of the following residues could be back-mutated as follows: I2→T, T22→S, A43→Q, K45→R, Y87→F.

BFU-11A8

When IGHV1-69*01 and IGHJ6*01 selected as BFU-11A8 heavy chain acceptor sequences, one or more of the following residues could be back-mutated as follows: R38→K, W47→L, M48→I, R66→K, V67→A, 169→L, S76→N, and Y91→F.

When IGKV3-11*01 and IGKJ4*01 selected as BFU-11A8 light chain acceptor sequences, one or more of the following residues could be back-mutated as follows: I2→T, S22→P, A43→Q, 158→V, Y87→F.

When IGKV1-5*01 and IGKJ4*01 selected as BFU-11A8 light chain acceptor sequences, one or more of the following residues could be back-mutated as follows: I2→T, M4→L, T22→P, A43→Q, Y87→F.

Example 6.1.4: Generation of Humanized Antibodies to PDGF Containing Framework Back-Mutations in CDR-Grafted Antibodies The following humanized variable regions of the murine monoclonal PDGF antibodies were cloned into IgG expression vectors for functional characterization.

Example 6.1.4.1: BDI-5H1-F6

TABLE 1.4.1

Sequences of Humanized BDI-5H1-F6 Variable Regions

| SEQ ID NO: | Protein region | Sequence 1234567890123456789012 34567890 |
|---|---|---|
| 3882 | hBDI-5H1-F6VH.1z | QVTLRESGPALVKPTQTLTLTCT FSGFSLS TFGMGVGWIRQPPGKALEWLANI WWDDDKY YNPSLKNRLTISKDTSKNQVVLT MTNMDPV DTATYYCARISTGISSYYVMDAW GQGTTVT VSS |
| 3883 | hBDI-5H1-F6VH.1 | EVTLRESGPALVKPTQTLTLTCT FSGFSLS TFGMGVGWIRQPPGKALEWLANI WWDDDKY YNPSLKNRLTISKDTSKNQVVLT MTNMDPV DTATYYCARISTGISSYYVMDAW GQGTTVT VSS |
| 3884 | hBDI-5H1-F6VH.1a | EVTLRESGPALVKPTQTLTLTCT FSGFSLS TFGMGVGWIRQPPGKGLEWLANI WWDDDKY YNPSLKNRLTISKDTSNNQAVLT ITNMDPV |

TABLE 1.4.1-continued

Sequences of Humanized BDI-5H1-F6 Variable Regions

| SEQ ID NO: | Protein region | Sequence 12345678901234567890123 4567890 |
|---|---|---|
| | | DTATYYCARISTGISSYYVMDAW GQGTTVT VSS |
| 3885 | hBDI-5H1-F6VH.1b | EVTLRESGPALVKPTQTLTLTCT FSGFSLS TFGMGVGWIRQPPGKGLEWLANI WWDDDKY YNPSLKNRLTISKDTSKNQVVLT ITNMDPV DTATYYCARISTGISSYYVMDAW GQGTTVT VSS |
| 3886 | hBDI-5H1-F6VH.1c | EVTLRESGPALVKPTQTLTLTCT FSGFSLS TFGMGVGWIRQPPGKGLEWLANI WWDDDKY YNPSLKTRLTISKDTSKNQVVLT ITNMDPV DTATYYCARISTGISSYYVMDAW GQGTTVT VSS |
| 3887 | hBDI-5H1-F6VH.2z | QVTLKESGPALVKPTQTLTLTCT FSGFSLS TFGMGVGWIRQPPGKALEWLANI WWDDDKY YNPSLKNRLTISKDTSKNQVVLT MTNMDPV DTATYYCARISTGISSYYVMDAW GQGTTVT VSS |
| 3888 | hBDI-5H1-F6VH.2 | EVTLKESGPALVKPTQTLTLTCT FSGFSLS TFGMGVGWIRQPPGKALEWLANI WWDDDKY YNPSLKNRLTISKDTSKNQVVLT MTNMDPV DTATYYCARISTGISSYYVMDAW GQGTTVT VSS |
| 3889 | hBDI-5H1-F6VH.2a | EVTLKESGPALVKPTQTLTLTCT FSGFSLS TFGMGVGWIRQPPGKGLEWLANI WWDDDKY YNPSLKNRLTISKDTSNSQAVLT ITNMDPV DTATYYCARISTGISSYYVMDAW GQGTTVT VSS |
| 3890 | hBDI-5H1-F6VH.2b | EVTLKESGPALVKPTQTLTLTCT FSGFSLS TFGMGVGWIRQPPGKALEWLANI WWDDDKY YNPSLKNRLTISKDTSKNQAVLT ITNMDPV DTATYYCARISTGISSYYVMDAW GQGTTVT VSS |
| 3891 | hBDI-5H1-F6VH.2c | EVTLRESGPALVKPTQTLTLTCT FSGFSLS TFGMGVGWIRQPPGKALEWLANI WWDDDKY YNPSLKNRLTISKDTSKNQAVLT ITNMDPV DTATYYCARISTGISSYYVMDAW GQGTTVT VSS |
| 3892 | hBDI-5H1-F6VH.v7 | EVQLVESGGGLVQPGGSLRLSCA FSGFSLS TFGMGVGWIRQAPGKGLEWLANI WWDDDKY YNPSLKNRLTISKDTSKNQAYLQ INSLRAE DTAVYYCARISTGISSYYVMDAW GQGTLVT VSS |
| 3893 | hBDI-5H1-F6VL.1 | NFMLTQPHSVSESPGKTVTISCE RSSGDIG DTYVSWYQQRPGSSPTTVIYGND QRPSGVP DRFSGSIDSSSNSASLTISGLKT EDEADYY CQSYDSDIDIVFGGGTKLTVL |
| 3894 | hBDI-5H1-F6VL.1a | NFMLTQPHSVSESPGKTVTISCE RSSGDIG DTYVSWYQQRPGSPPTNVIYGND QRPSGVP DRFSGSIDSSSNSASLTISGLKT EDEADYF CQSYDSDIDIVFGGGTKLTVL |
| 3895 | hBDI-5H1-F6VL.1b | QFMLTQPHSVSESPGKTVTIPCE RSSGDIG DTYVSWYQQRPGSPPTNVIYGND QRPSEVS DRFSGSIDSSSNSASLTISGLKT EDEADYF CQSYDSDIDIVFGGGTKLTVL |
| 3896 | hBDI-5H1-F6VL.1c | QFMLTQPHSVSESPGKTVTISCE RSSGDIG DTYVSWYQQRPGSSPTTVIYGND QRPSGVP DRFSGSIDSSSNSASLTISGLKT EDEADYF CQSYDSDIDIVFGGGTKLTVL |
| 3897 | hBDI-5H1-F6VL.2 | EIVLTQSPGTLSLSPGERATLSC ERSSGDI GDTYVSWYQQKPGQAPRLLIYGN DQRPSGI PDRFSGSGSGTDFTLTISRLEPE DFAVYYC QSYDSDIDIVFGGGTKVEIK |
| 3898 | hBDI-5H1-F6L.2a | EFVLTQSPGLSLSPGERATLSCE RSSGDIG DTYVSWYQQKPGQPPRNVIYGND QRPSGVP DRFSGSIDSSSNDATLTISRLEP EDFAVYF CQSYDSDIDIVFGGGTKVEIK |
| 3899 | hBDI-5H1-F6L.2b | EFVLTQSPGTLSLSPGERATLSC ERSSGDI GDTYVSWYQQKPGQAPRLVIYGN DQRPSGI PDRFSGSGSGTDFTLTISRLEPE DFAVYYC QSYDSDIDIVFGGGTKVEIK |
| 3900 | hBDI-5H1-F6L.2c | EFVLTQSPGTLSLSPGERATLSC ERSSGDI GDTYVSWYQQKPGQPPRNVIYGN DQRPSGV PDRFSGSGSGTDFTLTISRLEPE DFAVYFC QSYDSDIDIVFGGGTKVEIK |

TABLE 1.4.1-continued

Sequences of Humanized BDI-5H1-F6 Variable Regions

| SEQ ID NO: | Protein region | Sequence 1234567890123456789012345678901234567890 |
|---|---|---|
| 3901 | hBDI-5H1-F6VL.v6 | DFVLTQSPDSLAVSLGERATINCERSSGDI GDTYVSWYQQKPGQPPKNVIYGN DQRPSGVPDRFSGSGSGNSATLTISSLQAEDVAVYFCQSYDSDIDIVFGGGTKVEIK |
| 3902 | hBDI-5H1-F6VL.v7 | DFQLTQSPSSLSASVGDRVTITCERSSGDI GDTYVSWYQQKPGKAPKNVIYGN DQRPSGVPSRFSGSGSGNSATLTISSLQPEDFATYFCQSYDSDIDIVFGQGTKVEIK | hBDI-5H1-F6VH.1z is a CDR-grafted, humanized BDI-5H1-F6 VH containing IGHV2-70*01 and IGHJ6 framework sequences.

hBDI-5H1-F6VH.1 is based on .1z with a Q1E change to prevent pyroglutamate formation.

hBDI-5H1-F6VH.1a is a humanized design based on .1 and contains four proposed framework back-mutations (A44G, K75N, V78A and M82I).

hBDI-5H1-F6VH.1b is an intermediate design between .1 and .1a and only has two proposed framework back-mutations (A44G and M82I).

hBDI-5H1-F6VH.1c is based on .1b with additional one CDR germlining change N65T to improve identity to human germline sequence.

hBDI-5H1-F6VH.2z is a CDR-grafted, humanized BDI-5H1-F6 VH containing IGHV2-70*04 and IGHJ6 framework sequences.

hBDI-5H1-F6VH.2 is based on .2z with Q1E change to prevent pyroglutamate formation.

hBDI-5H1-F6VH.2a (hBDI-5H1-F6VH.1d) is based on .2 and contains four proposed framework back-mutations (K75N, N76S, V78A and M82I).

hBDI-5H1-F6VH.2b (hBDI-5H1-F6VH.v2) is an intermediate design between .2 and .2a and only has two proposed framework back-mutations (V78A and M82I).

hBDI-5H1-F6VH.2c (hBDI-5H1-F6VH.v6) is based on .2 and contains three proposed framework back-mutations (K5R, V78A, M82I).

hBDI-5H1-F6VH.v7 is a humanized BDI-5H1-F6 VH containing IGHV3-66*01 and IGHJ1 framework sequences with ten proposed framework back-mutations (A24F, V37I, V48L, S49A, F67L, R71K, N73T, T77Q, L78A, and M82I).

hBDI-5H1-F6VL.1 is a CDR-grafted humanized BDI-5H1-F6 VL containing IGLV6-57*01 and IGJL2*01 framework sequences.

hBDI-5H1-F6VL.1a is a humanized design based on .1 with 3 proposed framework back-mutations (S43P, T46N and Y87F).

hBDI-5H1-F6VL.1b is a humanized design based on .1 with 7 proposed framework back-mutations (N1Q, S22P, S43P, T46N, G57E, P59S, Y87F).

hBDI-5H1-F6VL.1c is an intermediate design between .1 and .1b with 2 back-mutations (N1Q and Y87F).

hBDI-5H1-F6VL.2 is a CDR-grafted humanized BDI-5H1-F6 VL containing IGKV3-20*01 and IGJK4*01 framework sequences.

hBDI-5H1-F6VL.2a is a humanized design based on .2 with 10 proposed framework back-mutations (I2F, A43P, L46N, L47V, I58V, G66I, G68S, T69N, F71A, Y87F) and one residue deletion (T10) and two residues insertion (D66a and S66b).

hBDI-5H1-F6VL.2b is based on .2a only with 2 proposed framework back-mutations (I2F, L47V) and without residues deletion (T10) and insertion (D66a, S66b).

hBDI-5H1-F6VL.2c is a humanized design on .2 with 6 proposed framework back-mutations (I2F, A43P, L46N, L47V, I58V, Y87F) and without residues deletion (T10) and insertion (D66a, S66b).

hBDI-5H1-F6VL.v6 is a humanized BDI-5H1-F6 VL containing IGKV4-1*01 and IGJK4*01 framework sequences with eight proposed framework back-mutations (I2F, M4L, L46N, L47V, T69N, D70S, F71A, Y87F).

hBDI-5H1-F6VL.v7 is a humanized BDI-5H1-F6 VL containing IGKV1-39*01 and IGJK1*01 framework sequences with eight proposed framework back-mutations (I2F, M4L, L46N, L47V, T69N, D70S, F71A, and Y87F).

Example 6.1.4.2: BDI-9E8-E7

TABLE 1.4.2

Sequences of Humanized BDI-9E8-E7 Variable Regions

| SEQ ID NO: | Protein region | Sequence 123456789012345678901234567890 |
|---|---|---|
| 3903 | hBDI-9E8-E7VH.1z | QVTLRESGPALVKPTQTLTLTCTFSGFSLS TYGMGVGWIRQPPGKALEWLANIWWDDDKY YNPSLKNRLTISKDTSKNQVVLTMTNMDPVDTATYYCARIESIGTTYSFDYWGQGTMVTVSS |
| 3904 | hBDI-9E8-E7VH.1 | EVTLRESGPALVKPTQTLTLTCTFSGFSLS TYGMGVGWIRQPPGKALEWLANIWWDDDKY YNPSLKNRLTISKDTSKNQVVLTMTNMDPVDTATYYCARIESIGTTYSFDYWGQGTMVTVSS |
| 3905 | hBDI-9E8-E7VH.1a | EVTLRESGPALVKPTQTLTLTCTFSGFSLS TYGMGVGWIRQPPGKGLEWLANIWWDDDKY YNPSLKNRLTISKDTSKNQAVLTITNMDPVDTATYYCARIESIGTTYSFDYWGQGTMVTVSS |
| 3906 | hBDI-9E8-E7VH.1b | EVTLRESGPALVKPTQTLTLTCTFSGFSLS TYGMGVGWIRQPPGKGLEWLANIWWDDDKY YNPSLKNRLTISKDTSKNQVVLTITNMDPVDTATYYCARIESIGTTYSFDYWGQGTMVTVSS |
| 3907 | hBDI-9E8-E7VH.1c | EVTLRESGPALVKPTQTLTLTCTFSGFSLS TYGMGVGWIRQPPGKGLEWLANIWWDDDKY YNPSLKTRLTISKDTSKNQVVLTITNMDPVDTATYYCARIESIGTTYSFDYWGQGTMVTVSS |
| 3908 | hBDI-9E8-E7VH.v6 | EVTLRESGPALVKPTQTLTLTCTFSGFSLS TYGMGVGWIRQPPGKALEWLANIWWDDDKY YNPSLKNRLTISKDTSKNQAVLTITNMDPVDTATYYCARIESIGTTYSFDYWGQGTTVTVSS |

TABLE 1.4.2-continued

Sequences of Humanized BDI-9E8-E7 Variable Regions

| SEQ ID NO: | Protein region | Sequence 1234567890123456789012345678 90 |
|---|---|---|
| 3909 | hBDI-9E8-E7VH.v7 | EVQLVESGGGLVQPGGSLRLSCAFSGFSLS TYGMGVGWIRQAPGKGLEWLANIWWDDDKY YNPSLKNRLTISKDTSKNQAYLQINSLRAE DTAVYYCARIESIGTTYSFDYWGQGTLVTV SS |
| 3910 | hBDI-9E8-E7VL.1 | NFMLTQPHSVSESPGKTVTISCERSSGDIG DSYVSWYQQRPGSSPTTVIYADDQRPSGVP DRFSGSIDSSSNSASLTISGLKTEDEADYY CQSYDINIDIVFGGGTKLTVL |
| 3911 | hBDI-9E8-E7VL.1a | NFMLTQPHSVSESPGKTVTISCERSSGDIG DSYVSWYQQRPGSPPTNVIYADDQRPSGVP DRFSGSIDSSSNSASLTISGLKTEDEADYF CQSYDINIDIVFGGGTKLTVL |
| 3912 | hBDI-9E8-E7VL.2 | EIVLTQSPGTLSLSPGERATLSCERSSGDI GDSYVSWYQQKPGQAPRLLIYADDQRPSGI PDRFSGSGSGTDFTLTISRLEPEDFAVYYC QSYDINIDIVFGGGTKVEIK |
| 3913 | hBDI-9E8-E7VL.2a | EFVLTQSPGLSLSPGERATLSCERSSGDIG DSYVSWYQQKPGQPPRNVIYADDQRPSGVP DRFSGSIDSSGNDATLTISRLEPEDFAVYF CQSYDINIDIVFGGGTKVEIK |
| 3914 | hBDI-9E8-E7VL.2b | EFVLTQSPGTLSLSPGERATLSCERSSGDI GDSYVSWYQQKPGQAPRLVIYADDQRPSGI PDRFSGSGSGTDFTLTISRLEPEDFAVYYC QSYDINIDIVFGGGTKVEIK |
| 3915 | hBDI-9E8-E7VL.v6 | DFVLTQSPDSLAVSLGERATINCERSSGDI GDSYVSWYQQKPGQPPKNVIYADDQRPSGV PDRFSGSGSGNSASLTISSLQAEDVAVYFC QSYDINIDIVFGGGTKVEIK |
| 3916 | hBDI-9E8-E7VL.v7 | DFQLTQSPSSLSASVGDRVTITCERSSGDI GDSYVSWYQQKPGKAPKNVIYADDQRPSGV PSRFSGSGSGNSASLTISSLQPEDFATYYC QSYDINIDIVFGQGTKVEIK | hBDI-9E8-E7VH.1z is a CDR-grafted, humanized BDI-9E8-E7 VH containing IGHV2-70*01 and IGHJ3*01 framework sequences.

hBDI-9E8-E7VH.1 is based on .1z with a Q1E change to prevent pyroglutamate formation.

hBDI-9E8-E7VH.1a is a humanized design based on .1 and contains three proposed framework back-mutations (A44G, V78A and M82I).

hBDI-9E8-E7VH.1b is an intermediate design between .1 and .1a and only has two proposed framework back-mutations (A44G and M82I).

hBDI-9E8-E7VH.1c is based on .1b with additional one CDR germlining change N65T to improve identity to human germline sequence.

hBDI-9E8-E7VH.v6 is a humanized BDI-9E8-E7 VH containing IGHV2-70*04 and IGHJ6 framework sequences with four proposed framework back-mutations (Q1E, K5R, V78A, and M82I).

hBDI-9E8-E7VH.v7 is a humanized BDI-9E8-E7 VH containing IGHV3-66*01 and IGHJ1 framework sequences with ten proposed framework back-mutations (A24F, V37I, V48L, S49A, F67L, R71K, N73T, T77Q, L78A, and M82I).

hBDI-9E8-E7VL.1 is a CDR-grafted humanized BDI-9E8-E7 VL containing IGLV6-57*01 and IGJL2*01 framework sequences.

hBDI-9E8-E7VL.1a is a humanized design based on .1 with three proposed framework back-mutations (S43P, T46N and Y87F).

hBDI-9E8-E7VL.2 is a CDR-grafted humanized BDI-9E8-E7 VL containing IGKV3-20*01 and IGJK4*01 framework sequences.

hBDI-9E8-E7VL.2a is a humanized design based on .2 with 9 proposed framework back-mutations (I2F, A43P, L46N, L47V, I58V, G66I, T69N, F71A, Y87F) and one residue deletion (T10) and two residues insertion (D66a and S66b).

hBDI-9E8-E7VL.2b is based on .2a only with 2 proposed framework back-mutations (I2F, L47V) and without residues deletion (T10) and insertion (D66a, S66b).

hBDI-9E8-E7VL.v6 is a humanized BDI-9E8-E7 VL containing IGKV4-1*01 and IGJK4*01 framework sequences with nine proposed framework back-mutations: (I2F, M4L, L46N, L47V, T69N, D70S, F71A, T72S, and Y87F).

hBDI-9E8-E7VL.v7 is a humanized BDI-9E8-E7 VL containing IGKV1-39*01 and IGJK1*01 framework sequences with eight proposed framework back-mutations: I2F, M4L, L46N, L47V, T69N, D70S, F71A, and T72S.

Example 6.1.4.3: BDI-7H10-D8

TABLE 1.4.3

Sequences of Humanized BDI-7H10-D8 Variable Regions

| SEQ ID NO: | Protein region | Sequence 1234567890123456789012345678 90 |
|---|---|---|
| 3917 | hBDI-7H10-D8VH.1z | QVQLVQSGAEVKKPGSSVKVSCKASGYTFT DYAMHWVRQAPGQGLEWMGTIIPLIDTTSY NQKFKGRVTITADESTSTAYMELSSLRSED TAVYYCARDWDNNWGYFDYWGQGTMVTVSS |
| 3918 | hBDI-7H10-D8VH.1 | EVQLVQSGAEVKKPGSSVKVSCKASGYTFT DYAMHWVRQAPGQGLEWMGTIIPLIDTTSY NQKFKGPVTITADESTSTAYMELSSLRSED TAVYYCARDWDNNWGYFDYWGQGTMVTVSS |
| 3919 | hBDI-7H10-D8VH.1a | EVQLVQSGAEVKKPGSSVKVSCKASGYTFT DYAMHWVRQAPGQGLEWIGTIIPLIDTTSY NQKFKGRATLTADTSTNTAYMELSSLRSED TAVYYCARDWDNNWGYFDYWGQGTMVTVSS |
| 3920 | hBDI-7H10-D8VH.1b | EVQLVQSGAEVKKPGSSVKVSCKASGYTFT DYAMHWVRQAPGQGLEWIGTIIPLIDTTSY NQKFKGPVTITADESTSTAYMELSSLRSED TAVYYCARDWDNNWGYFDYWGQGTMVTVSS |
| 3921 | hBDI-7H10-D8VH.1c | EVQLVQSGAEVKKPGSSVKVSCKASGGTFS DYAMHWVRQAPGQGLEWIGTIIPLIDTTSY NQKFKGRVTITADESTSTAYMELSSLRSED TAVYYCARDWDNNWGYFDYWGQGTMVTVSS |
| 3922 | hBDI-7H10-D8VL.1 | DIVMTQTPLSLSVTPGQPASISCRSSQSLE YSDGYTYLEWYLQKPGQSPQLLIYGVSNRF SGVPDPFSGSGSGTDFTLKISPVEAEDVGV YYCFQATHDPLTFGQGTKLEIK |
| 3923 | hBDI-7H10-D8VL.1a | DVVLTQTPLSLSVTPGQPASISCRSSQSLE YSDGYTYLEWYLQKPGQSPQLLIYGVSNRF SGVPDPFSGSGSGTDFTLKISPVEAEDVGV YYCFQATHDPLTFGQGTKLEIK |

TABLE 1.4.3-continued

Sequences of Humanized BDI-7H10-D8 Variable Regions

| SEQ ID NO: | Protein region | Sequence<br>123456789012345678901234567890 |
|---|---|---|
| 3924 | hBDI-7H10-D8VL.1b | DVVMTQTPLSLSVTPGQPASISCRSSQSLE YSDGYTYLEWYLQKPGQSPQLLIYGVSNRF SGVPDPFSGSGSGTDFTLKISPVEAEDVGV YYCFQATHDPLTFGQGTKLEIK | hBDI-7H10-D8VH.1z is a CDR-grafted, humanized BDI-7H10-D8 VH containing IGHV1-69*01 and IGHJ3 framework sequences.

hBDI-7H10-D8VH.1 is based on .1z with a Q1E change to prevent pyroglutamate formation.

hBDI-7H10-D8VH.1a is a humanized design based on .1 and contains five proposed framework back-mutations (M48I, V67A, I69L, E73T and S76N).

hBDI-7H10-D8VH.1b is an intermediate design between .1 and .1a and only has one proposed framework back-mutation M48I.

hBDI-7H10-D8VH.1c is based on .1b with two additional CDR germlining changes Y27G and T30S.

hBDI-7H10-D8VL.1 is a CDR-grafted humanized BDI-7H10-D8 VL containing IGKV2-29*02 and IGKJ2 framework sequences.

hBDI-7H10-D8VL.1a is a humanized design based on .1 with 2 proposed framework back-mutations I2V and M4L.

hBDI-7H10-D8VL.1b is an intermediate design between .1 and .1a with only one proposed framework back-mutation I2V.

Example 6.1.4.4: BDI-1E1-D5

TABLE 1.4.4

Sequences of Humanized BDI-1E1-D5 Variable Regions

| SEQ ID NO: | Protein region | Sequence<br>123456789012345678901234567890 |
|---|---|---|
| 3925 | hBDI-1E1-D5VH.1z | QVQLVQSGAEVKKPGSSVKVSCKASGYTFT DYVMHWVRQAPGQGLEWMGTIIPLIDTTSY NQKFKGRVTITADKSTSTAYMELSSLRSED TAVYYCARTSPYYYSSYDVMDAWGQGTTVT VSS |
| 3926 | hBDI-1E1-D5VH.1 | EVQLVQSGAEVKKPGSSVKVSCKASGYTFT DYVMHWVRQAPGQGLEWMGTIIPLIDTTSY NQKFKGRVTITADKSTSTAYMELSSLRSED TAVYYCARTSPYYYSSYDVMDAWGQGTTVT VSS |
| 3927 | hBDI-1E1-D5VH.1a | EVQLVQSGAEVKKPGSSVKVSCKASGYTFT DYVMHWVRQAPGQGLEWMGTIIPLIDTTSY NQKFKGRATLTADKSTNTAYMELSSLRSED TAVYYCARTSPYYYSSYDVMDAWGQGTTVT VSS |
| 3928 | hBDI-1E1-D5VH.1b | EVQLVQSGAEVKKPGSSVKVSCKASGYTFT DYVMHWVRQAPGQGLEWIGTIIPLIDTTSY NQKFKGRVTITADKSTSTAYMELSSLRSED TAVYYCARTSPYYYSSYDVMDAWGQGTTVT VSS |

TABLE 1.4.4-continued

Sequences of Humanized BDI-1E1-D5 Variable Regions

| SEQ ID NO: | Protein region | Sequence<br>123456789012345678901234567890 |
|---|---|---|
| 3929 | hBDI-1E1-D5VL.1 | AIQLTQSPSSLSASVGDRVTITCKGSQNIN NYLAWYQQKPGKAPKLLIYKTNNLQTGVPS RFSGSGSGTDFTLTISSLQPEDFATYYCYQ YDNGYTFGQGTKLEIK |
| 3930 | hBDI-1E1-D5VL.1a | AIQLTQSPSSLSASVGDRVTITCKGSQNIN NYLAWYQQKPGKAPKLLIYKTNNLQTGIPS RFSGSGSGTDYTLTISSLQPEDFATYYCYQ YDNGYTFGQGTKLEIK |
| 3931 | hBDI-1E1-D5VL.2 | EIVLTQSPATLSLSPGERATLSCKGSQNIN NYLAWYQQKPGQAPRLLIYKTNNLQTGIPA RFSGSGSGTDFTLTISSLEPEDFAVYYCYQ YDNGYTFGQGTKLEIK |
| 3932 | hBDI-1E1-D5VL.2a | EIVLTQSPATLSLSPGERATLSCKGSQNIN NYLAWYQQKPGQAPRLLIYKTNNLQTGIPA RFSGSGSGTDYTLTISSLEPEDFATYYCYQ YDNGYTFGQGTKLEIK | hBDI-1E1-D5VH.1z is a CDR-grafted, humanized BDI-1E1-D5 VH containing IGHV1-69*06 and JH6 framework sequences.

hBDI-1E1-D5VH.1 is based on .1z with a Q1E change to prevent pyroglutamate formation.

hBDI-1E1-D5VH.1a is a humanized design based on .1 and contains four proposed framework back-mutations (M48I, V67A, I69L and S76N).

hBDI-1E1-D5VH.1b is an intermediate design between .1 and .1a and only has one back-mutations M48I. This design eliminates Carter residue back-mutations.

hBDI-1E1-D5VL.1 is a CDR-grafted humanized BDI-1E1-D5 VL containing IGKV1D-13*01 and Jk2 framework sequences.

hBDI-1E1-D5VL.1a is a humanized design based on .1 with 2 proposed framework back-mutations (V58I and F71Y).

hBDI-1E1-D5VL.2 is a CDR-grafted humanized BDI-1E1-D5 VL containing IGKV3-11*01 and Jk2 framework sequences.

hBDI-1E1-D5VL.2a is a humanized design based on .2 with 2 proposed framework back-mutations (F71Y and V85T).

Example 6.1.4.5: BDI-6A3-A9

TABLE 1.4.5

Sequences of Humanized BDI-6A3-A9 Variable Regions

| SEQ ID NO: | Protein region | Sequence<br>123456789012345678901234567890 |
|---|---|---|
| 3933 | BDI-6A3-A9VH.1 | EVQLVESGGGLVQPGGSLRLSCAASGFSFS DSAMAWVRQAPGKGLEWVATIIYDGSGTYY RDSVKGRFTISRDNAKNSLYLQMNSLRAED TAVYYCARLGFNYGNYGYYVMDAWGQGTTV TVSS |
| 3934 | hBDI-6A3-A9VH.1a | EVQLVESGGGLVQPGGSLRLSCAASGFSFS DSAMAWVRQAPGKGLEWVATIIYDGSGTYY RDSVKGRFTISRDNAKSSLYLQMNSLRAED TAVYYCARLGFNYGNYGYYVMDAWGQGTTV TVSS |

TABLE 1.4.5-continued

Sequences of Humanized BDI-6A3-A9 Variable Regions

| SEQ ID NO: | Protein region | Sequence 12345678901234567890123456789 0 |
|---|---|---|
| 3935 | hBDI-6A3-A9VH.1b | EVQLVESGGGLVQPGGSLRLSCAASGFTFS DSAMAWVRQAPGKGLEWVATIIYDGSGTYY VDSVKGRFTISRDNAKNSLYLQMNSLRAED TAVYYCARLGFNYGNYGYYVMDAWGQGTTV TVSS |
| 3936 | hBDI-6A3-A9VH.2z | QVQLVQSGAEVKKPGASVKVSCKASGFSFS DSAMAWVRQAPGQRLEWMGTIIYDGSGTYY RDSVKGRVTITRDTSASTAYMELSSLRSED TAVYYCARLGFNYGNYGYYVMDAWGQGTTV TVSS |
| 3937 | hBDI-6A3-A9VH.2 | EVQLVQSGAEVKKPGASVKVSCKASGFSFS DSAMAWVRQAPGQRLEWMGTIIYDGSGTYY RDSVKGRVTITRDTSASTAYMELSSLRSED TAVYYCARLGFNYGNYGYYVMDAWGQGTTV TVSS |
| 3938 | hBDI-6A3-A9VH.2a | EVQLVQSGAEVKKPGASVKVSCKASGFSFS DSAMAWVRQAPGQGLEWVATIIYDGSGTYY RDSVKGRFTITRDNSASTLYLELSSLRSED TAVYYCARLGFNYGNYGYYVMDAWGQGTTV TVSS |
| 3939 | hBDI-6A3-A9VH.2b | EVQLVQSGAEVKKPGASVKVSCKASGFSFS DSAMAWVRQAPGQGLEWVGTIIYDGSGTYY RDSVKGRVTITRDTSASTAYLELSSLRSED TAVYYCARLGFNYGNYGYYVMDAWGQGTTV TVSS |
| 3940 | hBDI-6A3-A9VL.1 | NFMLTQPHSVSESPGKTVTISCERSSGDIG DSYVSWYQQRPGSSPTTVIYADDQRPSGVP DRFSGSIDSSSNSASLTISGLKTEDEADYY CQSYDSNIDINIVFGGGTKLTVL |
| 3941 | hBDI-6A3-A9VL.1a | NFMLTQPHSVSESPGKTVTISCERSSGDIG DSYVSWYQQRPGSSPPTNVIFADDQRPSGVP DRFSGSIDSSSNSASLTISGLKTEDEADYF CQSYDSNIDINIVFGGGTKLTVL |
| 3942 | hBDI-6A3-A9VL.1b | NFMLTQPHSVSESPGKTVTISCERSSGDIG DSYVSWYQQRPGSSPTTVIFADDQRPSGVP DRFSGSIDSSSNSASLTISGLKTEDEADYY CQSYDSNIDINIVFGGGTKLTVL | hBDI-6A3-A9VH.1 is a CDR-grafted, humanized BDI-6A3-A9 VH containing IGHV3-7*01 and JH6 framework sequences.

hBDI-6A3-A9VH.1a is a humanized design based on .1 and contains one proposed framework back-mutation N76S.

hBDI-6A3-A9VH.1b is based on .1 with additional two CDR germlining changes S28T and R60V to improve identity to human germline sequence.

hBDI-6A3-A9VH.2z is a CDR-grafted, humanized BDI-6A3-A9 VH containing IGHV1-3*01 and JH6 framework sequences.

hBDI-6A3-A9VH.2 is based on .2z with a Q1E change to prevent pyroglutamate formation.

hBDI-6A3-A9VH.2a is a humanized design based on .2 and contains seven proposed framework back-mutations R44G, M48V, G49A, V67F, T73N, A78L and M80L.

hBDI-6A3-A9VH.2b is an intermediate design between .2 and .2a with only three proposed framework back-mutations R44G, M48V and M80L.

hBDI-6A3-A9VL.1 is a CDR-grafted humanized BDI-6A3-A9 VL containing IGLV6-57*01 and JL2 framework sequences.

hBDI-6A3-A9VL.1a is a humanized design based on .1 with 4 proposed framework back-mutations (S43P, T46N, Y49F and Y87F).

hBDI-6A3-A9VL.1b is an intermediate design between .1 and .1a with only 1 proposed framework back-mutation Y49F.

Example 6.1.4.6: BFU-3E2

TABLE 1.4.6

Sequences of Humanized BFU-3E2 Variable Regions

| SEQ ID NO: | Protein region | Sequence 12345678901234567890123456789 0 |
|---|---|---|
| 3943 | hBFU-3E2VH.1z | QVQLVQSGAEVKKPGSSVKVSCKASGYTFT ESYMYWVRQAPGQGLEWMGRIDPEDGSTDY VEKFKNRVTITADESTSTAYMELSSLRSED TAVYYCARFGARSYFYPMDAWGQGTTVTVS S |
| 3944 | hBFU-3E2VH.1 | EVQLVQSGAEVKKPGSSVKVSCKASGYTFT ESYMYWVRQAPGQGLEWMGRIDPEDGSTDY VEKFKNRVTITADESTSTAYMELSSLRSED TAVYYCARFGARSYFYPMDAWGQGTTVTVS S |
| 3945 | hBFU-3E2VH.1a | EVQLVQSGAEVKKPGSSVKVSCKASGYTFT ESYMYWVKQAPGQGLELIGRIDPEDGSTDY VEKFKNRVTITADESTSTAYMELSSLRSED TAVYYCARFGARSYFYPMDAWGQGTTVTVS S |
| 3946 | hBFU-3E2VH.1b | EVQLVQSGAEVKKPGSSVKVSCKASGYTFT ESYMYWVRQAPGQGLELIGRIDPEDGSTDY VEKFKNRVTLTADESTSTAYMELSSLRSED TAVYYCARFGARSYFYPMDAWGQGTTVTVS S |
| 3947 | hBFU-3E2VH.1c | EVQLVQSGAEVKKPGSSVKVSCKASGYTFT ESYMYWVRQAPGQGLELIGRIDPEDGSTDY VEKFKNRVTITADESTSTAYMELSSLRSED TAVYYCARFGARSYFYPMDAWGQGTTVTVS S |
| 3948 | hBFU-3E2VH.1d | EVQLVQSGAEVKKPGSSVKVSCKASGYTFT ESYMYWVKQAPGQSLELIGRIDPEDGSTDY VEKFKNKATLTADESTNTAYMELSSLRSED TAVYFCARFGARSYFYPMDAWGQGTTVTVS S |
| 3949 | hBFU-3E2VL.1 | EIVLTQSPATLSLSPGERATLSCRASESVS TLMHWYQQKPGQAPRLLIYGASNLESGIPA RFSGSGSGTDFTLTISSLEPEDFAVYYCQQ SWNDPWTFGGGTKVEIK |
| 3950 | hBFU-3E2VL.1a | ETVLTQSPATLSLSPGERATLSCRASESVS TLMHWYQQKPGQQPRLLIYGASNLESGVPA RFSGSGSGTDFTLTISSLEPEDFAVYFCQQ SWNDPWTFGGGTKVEIK |
| 3951 | hBFU-3E2VL.1b | ETVLTQSPATLSLSPGERATLSCRASESVS TLMHWYQQKPGQAPRLLIYGASNLESGVPA RFSGSGSGTDFTLTISSLEPEDFAVYFCQQ SWNDPWTFGGGTKVEIK |
| 3952 | hBFU-3E2VL.1c | ETVLTQSPATLSLSPGERATLSCRASESVS TLMHWYQQKPGQAPRLLIYGASNLESGIPA RFSGSGSGTDFTLTISSLEPEDFAVYYCQQ SWNDPWTFGGGTKVEIK |
| 3953 | hBFU-3E2VL.2 | AIQLTQSPSSLSASVGDRVTITCRASESVS TLMHWYQQKPGKAPKLLIYGASNLESGVPS RFSGSGSGTDFTLTISSLQPEDFATYYCQQ SWNDPWTFGGGTKVEIK |

TABLE 1.4.6-continued

Sequences of Humanized BFU-3E2 Variable Regions

| SEQ ID NO: | Protein region | Sequence 12345678901234567890123456789 0 |
|---|---|---|
| 3954 | hBFU-3E2VL.2a | ATQLTQSPSSLSASVGDRVTISCRASESVS TLMHWYQQKPGKQPRLLIYGASNLESGVPS RFSGSGSGTDFTLTISSLQPEDFATYFCQQ SWNDPWTFGGGTKVEIK |
| 3955 | hBFU-3E2VL.2b | ATQLTQSPSSLSASVGDRVTITCRASESVS TLMHWYQQKPGKAPRLLIYGASNLESGVPS RFSGSGSGTDFTLTISSLQPEDFATYFCQQ SWNDPWTFGGGTKVEIK |
| 3956 | hBFU-3E2VL.2c | ATQLTQSPSSLSASVGDRVTITCRASESVS TLMHWYQQKPGKAPRLLIYGASNLESGVPS RFSGSGSGTDFTLTISSLQPEDFATYYCQQ SWNDPWTFGGGTKVEIK | hBFU-3E2VH.1z is a CDR-grafted, humanized BFU-3E2 VH containing IGHV1-69*01 and IGHJ6*01 framework sequences.

hBFU-3E2VH.1 is based on .1z with a Q1E change to prevent pyroglutamate formation.

hBFU-3E2VH.1a is a humanized design based on .1 and contains 7 proposed framework back-mutations (R38K, W47L, M48I, R66K, V67A, I69L, Y91F).

hBFU-3E2VH.1b is an intermediate design between .1 and .1a and contains 3 proposed framework back-mutations (W47L, M48I, I69L).

hBFU-3E2VH.1c is an intermediate design between .1 and .1a and contains 2 proposed framework back-mutations (W47L, M48I.)

hBFU-3E2VH.1d is a humanized design based on .1 and contains 9 proposed framework back-mutations (R38K, G44S, W47L, M48I, R66K, V67A, I69L, S76N, Y91F)

hBFU-3E2VL.1 is a CDR-grafted, humanized BFU-3E2 VL containing IGKV3-11*01 and IGKJ4*01 framework sequences.

hBFU-3E2VL.1a is a humanized design based on .1 and contains 4 proposed framework back-mutations (I2T, A43Q, I58V, Y87F).

hBFU-3E2VL.1b is an intermediate design between .1 and .1a. It contains 3 proposed framework back-mutations (I2T, I58V, Y87F).

hBFU-3E2VL.1c is a design based on .1b and contains 1 proposed framework back-mutations: I2T.

hBFU-3E2VL.2 is a CDR-grafted, humanized BFU-3E2 VL containing IGKV1-13*01 and IGKJ4*01 framework sequences.

hBFU-3E2VL.2a is a humanized design based on .2 and contains 5 proposed framework back-mutations (I2T, T22S, A43Q, K45R, Y87F).

hBFU-3E2VL.2b is an intermediate design between .2 and 2a. It contains 3 proposed framework back-mutations (I2T, K45R, Y87F).

hBFU-3E2VL.2c is a design based on .2b and contains 2 proposed framework back-mutations (I2T, K45R).

Example 6.1.4.7: BFU-11A8

TABLE 1.4.7

Sequences of Humanized BFU-11A8 Variable Regions

| SEQ ID NO:1 | Protein region | Sequence 12345678912345678912345678 90 |
|---|---|---|
| 3957 | hBFU-11A8VH.1z | QVQLVQSGAEVKKPGSSVKVSCKASGYTFT ESYIYWVRQAPGQGLEWMGRIDPEDGSTDY VEKFKNRVTITADESTSTAYMELSSLRSED TAVYYCARFGARSYFYPMDAWGQGTTVTVS S |
| 3958 | hBFU-11A8VH.1 | EVQLVQSGAEVKKPGSSVKVSCKASGYTFT ESYIYWVRQAPGQGLEWMGRIDPEDGSTDY VEKFKNRVTITADESTSTAYMELSSLRSED TAVYYCARFGARSYFYPMDAWGQGTTVTVS S |
| 3959 | hBFU-11A8VH.1a | EVQLVQSGAEVKKPGSSVKVSCKASGYTFT ESYIYWVKQAPGQGLELIGRIDPEDGSTDY VEKFKNKATLTADESTNTAYMELSSLRSED TAVYFCARFGARSYFYPMDAWGQGTTVTVS S |
| 3960 | hBFU-11A8VH.1b | EVQLVQSGAEVKKPGSSVKVSCKASGYTFT ESYIYWVRQAPGQGLELIGRIDPEDGSTDY VEKFKNRVTLTADESTNTAYMELSSLRSED TAVYYCARFGARSYFYPMDAWGQGTTVTVS S |
| 3961 | hBFU-11A8VH.1c | EVQLVQSGAEVKKPGSSVKVSCKASGYTFT ESYIYWVRQAPGQGLELIGRIDPEDGSTDY VEKFKNRVTITADESTSTAYMELSSLRSED TAVYYCARFGARSYFYPMDAWGQGTTVTVS S |
| 3962 | hBFU-11A8VL.1 | EIVLTQSPATLSLSPGERATLSCRASESVS TLMHWYQQKPGQAPRLLIYGASNLESGIPA RFSGSGSGTDFTLTISSLEPEDFAVYYCQQ SWNDPWTFGGGTKVEIK |
| 3963 | hBFU-11A8VL.1a | ETVLTQSPATLSLSPGERATLPCRASESVS TLMHWYQQKPGQQPRLLIYGASNLESGVPA RFSGSGSGTDFTLTISSLEPEDFAVYFCQQ SWNDPWTFGGGTKVEIK |
| 3964 | hBFU-11A8VL.1b | ETVLTQSPATLSLSPGERATLSCRASESVS TLMHWYQQKPGQAPRLLIYGASNLESGVPA RFSGSGSGTDFTLTISSLEPEDFAVYFCQQ SWNDPWTFGGGTKVEIK |
| 3965 | hBFU-11A8VL.1c | ETVLTQSPATLSLSPGERATLSCRASESVS TLMHWYQQKPGQAPRLLIYGASNLESGIPA RFSGSGSGTDFTLTISSLEPEDFAVYYCQQ SWNDPWTFGGGTKVEIK |
| 3966 | hBFU-11A8VL.2 | DIQMTQSPSTLSASVGDRVTITCRASESVS TLMHWYQQKPGKAPKLLIYGASNLESGVPS RFSGSGSGTEFTLTISSLQPDDFATYYCQQ SWNDPWTFGGGTKVEIK |
| 3967 | hBFU-11A8VL.2a | DTQLTQSPSTLSASVGDRVTIPCRASESVS TLMHWYQQKPGKQPKLLIYGASNLESGVPS RFSGSGSGTEFTLTISSLQPDDFATYFCQQ SWNDPWTFGGGTKVEIK |
| 3968 | hBFU-11A8VL.2b | DTQLTQSPSTLSASVGDRVTITCRASESVS TLMHWYQQKPGKAPKLLIYGASNLESGVPS RFSGSGSGTEFTLTISSLQPDDFATYFCQQ SWNDPWTFGGGTKVEIK |
| 3969 | hBFU-11A8VL.2c | DTQMTQSPSTLSASVGDRVTITCRASESVS TLMHWYQQKPGKAPKLLIYGASNLESGVPS RFSGSGSGTEFTLTISSLQPDDFATYYCQQ SWNDPWTFGGGTKVEIK | hBFU-11A8VH.1z is a CDR-grafted, humanized BFU-11A8 VH containing IGHV1-69*01 and IGHJ6*01 framework sequences.

hBFU-11A8VH.1 is based on .1z with a Q1E change to prevent pyroglutamate formation.

hBFU-11A8VH.1a is a humanized design based on .1 and contains 8 proposed framework back-mutations: R38K, W47L, M48I, R66K, V67A, I69L, S76N, Y91F.

hBFU-11A8VH.1b is an intermediate design between .1 and .1a and contains 4 proposed framework back-mutations: W47L, M48I, I69L, S76N.

hBFU-11A8VH.1c is a design based on .1b and contains 2 proposed framework back-mutations: W47L, M48I.

hBFU-11A8VL.1 is a CDR-grafted, humanized BFU-11A8 VL containing IGKV3-11*01 and IGKJ4*01 framework sequences.

hBFU-11A8VL.1a is a humanized design based on .1 and contains 5 proposed framework back-mutations: I2T, S22P, A43Q, I58V, Y87F.

hBFU-11A8VL.1b is an intermediate design between .1 and .1a. It contains 3 proposed framework back-mutations: I2T, I58V, Y87F.

hBFU-11A8VL.1c is a design based on .1b and contains 1 proposed framework back-mutations: I2T.

hBFU-11A8VL.2 is a CDR-grafted, humanized BFU-11A8 VL containing IGKV1-5*01 and IGKJ4*01 framework sequences.

hBFU-11A8VL.2a is a humanized design based on .2 and contains 5 proposed framework back-mutations: I2T, M4L, T22P, A43Q, Y87F.

hBFU-11A8VL.2b is an intermediate design between .2 and .2a. It contains 3 proposed framework back-mutations: I2T, M4L, Y87F.

hBFU-11A8VL.2c is a design based on .2b and contains 1 proposed framework back-mutations: I2T.

Example 6.2: Humanization of VEGF Antibodies

Example 6.2.1: Humanization Method

Antibody humanization is achieved by grafting CDRs of the rodent antibody onto a "similar" human framework (acceptor) and incorporating minimal number of key framework residues (back-mutation) from the rodent antibody that are selected to maintain the original CDR conformation in order to minimize the immunogenicity while retaining the optimal antigen binding.

Example 6.2.2: Human Germline Sequence Selections for Constructing CDR-Grafted, Humanized VEGF Antibodies By applying the aforementioned method, the CDR sequences of VH and VL chains of monoclonal antibodies BDB-4G8-D4, BEW-9A8-E2, BEW-6C2-C8, BEW-9D2-E8, BEW-9E3-B9, BEW-5C3, BEW-9E10, BEW-1B10, and BEW-1E3 were grafted onto different human heavy and light chain acceptor sequences.

Example 6.2.2.1: BDB-4G8-D4

Based on the alignments with the VH and VL sequences of monoclonal antibody BDB-4G8-D4 of the present invention, the following known human sequences are selected:

1. IGHV7-4-1*02 and IGHJ3*01 for constructing heavy chain acceptor sequences

2. IGHV1-18*01 and IGHJ3*01 as backup acceptor sequences for constructing heavy chain 3. IGHV5-51*01 and IGHJ3*01 as backup acceptor sequences for constructing heavy chain 4. IGHV3-66*01 and IGHJ1*01 as backup acceptor sequences for constructing heavy chain 5. IGKV1D-13*01 and IGKJ2*01 for constructing light chain acceptor sequences 6. IGKV3-11*01 and IGKJ2*01 as alternative acceptor sequences for constructing light chain 7. IGKV3-15*01 and IGKJ5*01 as alternative acceptor sequences for constructing light chain 8. IGKV3-15*01 and IGKJ1*01 as alternative acceptor sequences for constructing light chain 9. IGKV1-39*01 and IGKJ1*01 as alternative acceptor sequences for constructing light chain.

By grafting the corresponding VH and VL CDRs of BDB-4G8-D4 into said acceptor sequences, the CDR-grafted, humanized, and modified VH and VL sequences were prepared.

Example 6.2.2.2: BEW-9A8-E2

Based on the alignments with the VH and VL sequences of monoclonal antibody BEW-9A8-E2 of the present invention the following known human sequences are selected:

1. IGHV7-81*01 and IGHJ1*01 for constructing heavy chain acceptor sequences

2. IGHV1-18*01 and IGHJ1*01 as alternative acceptor sequence for constructing heavy chain 3. IGHV7-4-1*01 and IGHJ1*01 as alternative acceptor sequence for constructing heavy chain 4. IGKV6-21*01 and IGKJ2*01 for constructing light chain acceptor sequences 5. IGKV1-39*01 and IGKJ2*01 as alternative acceptor sequence for constructing light chain 6. IGKV3-11*01 and IGKJ2*01 as alternative acceptor sequence for constructing light chain 7. IGKV1-13*01 and IGKJ2*01 as alternative acceptor sequence for constructing light chain By grafting the corresponding VH and VL CDRs of BEW-9A8-E2 into said acceptor sequences, the CDR-grafted, humanized, and modified VH and VL sequences were prepared.

Example 6.2.2.3: BEW-6C2-C8

Based on the alignments with the VH and VL sequences of monoclonal antibody BEW-6C2-C8 of the present invention the following known human sequences are selected:

1. IGHV3-7*01 and IGHJ3*01 for constructing heavy chain acceptor sequences

2. IGKV3-11*01 and IGKJ2*01 for constructing light chain acceptor sequences

3. IGKV1-39*01 and IGKJ2*01 as alternative acceptor sequence for constructing light chain By grafting the corresponding VH and VL CDRs of BEW-6C2-C8 into said acceptor sequences, the CDR-grafted, humanized, and modified VH and VL sequences were prepared.

Example 6.2.2.4: BEW-9D2-E8

Based on the alignments with the VH and VL sequences of monoclonal antibody BEW-9D2-E8 of the present invention the following known human sequences are selected:

1. IGHV7-81*01 and IGHJ4*01 for constructing heavy chain acceptor sequences
2. IGHV1-18*01 and IGHJ4*01 as alternative acceptor sequence for constructing heavy chain
3. IGKV3-11*01 and IGKJ2*01 for constructing light chain acceptor sequences
4. IGKV1-39*01 and IGKJ2*01 as alternative acceptor sequence for constructing light chain By grafting the corresponding VH and VL CDRs of BEW-9D2-E8 into said acceptor sequences, the CDR-grafted, humanized, and modified VH and VL sequences were prepared.

Example 6.2.2.5: BEW-9E3-B9

Based on the alignments with the VH and VL sequences of monoclonal antibody BEW-9E3-B9 of the present invention the following known human sequences are selected:
1. IGHV7-81*01 and IGHJ4*01 for constructing heavy chain acceptor sequences
2. IGHV1-18*01 and IGHJ4*01 as alternative acceptor sequence for constructing heavy chain
3. IGKV3-11*01 and IGKJ2*01 for constructing light chain acceptor sequences
4. IGKV1-39*01 and IGKJ2*01 as alternative acceptor sequence for constructing light chain By grafting the corresponding VH and VL CDRs of BEW-9E3-B9 into said acceptor sequences, the CDR-grafted, humanized, and modified VH and VL sequences were prepared.

Example 6.2.2.6: BEW-5C3

Based on the alignments with the VH and VL sequences of monoclonal antibody BEW-5C3 of the present invention, the following known human sequences are selected:
1. IGHV7-4-1*01 and IGHJ1*01 for constructing heavy chain acceptor sequences
2. IGHV1-69*06 and IGHJ1*01 as alternative acceptor for constructing heavy chain
3. IGKV3-11*01 and IGKJ4*01 for constructing light chain acceptor sequences
4. IGKV1-13*01 and IGKJ4*01 as alternative acceptor for constructing light chain By grafting the corresponding VH and VL CDRs of BEW-5C3 into said acceptor sequences, the CDR-grafted, humanized, and modified VH and VL sequences were prepared.

Example 6.2.2.7: BEW-9E10

Based on the alignments with the VH and VL sequences of monoclonal antibody BEW-9E10 of the present invention, the following known human sequences are selected:
1. IGHV7-4-1*01 and IGHJ1*01 for constructing heavy chain acceptor sequences
2. IGHV1-69*06 and IGHJ1*01 as alternative acceptor for constructing heavy chain
3. IGKV1-27*01 and IGKJ2*01 for constructing light chain acceptor sequences By grafting the corresponding VH and VL CDRs of BEW-9E10 into said acceptor sequences, the CDR-grafted, humanized, and modified VH and VL sequences were prepared.

Example 6.2.2.8: BEW-1B10

Based on the alignments with the VH and VL sequences of monoclonal antibody BEW-1B10 of the present invention, the following known human sequences are selected:
1. IGHV3-7*01 and IGHJ6*01 for constructing heavy chain acceptor sequences
2. IGKV1-39*01 and IGKJ4*01 for constructing light chain acceptor sequences By grafting the corresponding VH and VL CDRs of BEW-1B10 into said acceptor sequences, the CDR-grafted, humanized, and modified VH and VL sequences were prepared.

Example 6.2.2.9: BEW-1E3

Based on the alignments with the VH and VL sequences of monoclonal antibody BEW-1E3 of the present invention, the following known human sequences are selected:
1. IGHV7-4-1*01(0-1) and IGHJ1*01 for constructing heavy chain acceptor sequences
2. IGHV1-18*01 and IGHJ1*01 as alternative acceptor for constructing heavy chain
3. IGKV3-11*01 and IGKJ2*01 for constructing light chain acceptor sequences
4. IGKV1-13*01 and IGKJ2*01 as alternative acceptor for constructing light chain By grafting the corresponding VH and VL CDRs of BEW-1E3 into said acceptor sequences, the CDR-grafted, humanized, and modified VH and VL sequences were prepared.

Example 6.2.3: Introducing Potential Framework Back-Mutations in CDR-Grafted Antibodies To generate humanized antibody with potential framework back-mutations, the mutations were identified and introduced into the CDR-grafted antibody sequences by de novo synthesis of the variable domain, or mutagenic oligonucleotide primers and polymerase chain reactions, or by methods well known in the art. Different combinations of back mutations and other mutations are constructed for each of the CDR-grafts as follows. Residue numbers for these mutations are based on the Kabat numbering system.

Example 6.2.3.1: BDB-4G8-D4

When IGHV7-4-1*02 and IGHJ3*01 selected as BDB-4G8-D4 heavy chain acceptor sequences, one or more of the following residues could be back-mutated as follows: Q1→, V2→I, W47→Y, and Y91→F.

When IGHV1-18*01 and IGHJ3*01 selected as BDB-4G8-D4 heavy chain acceptor sequences, one or more of the following residues could be back-mutated as follows: Q1→E, V2→I, W47→Y, V67→F, M69→F, T71→L and Y91→F.

When IGHV5-51*01 and IGHJ3*01 selected as BDB-4G8-D4 heavy chain acceptor sequences, one or more following residues could be back-mutated as follows: V2→I, A9→T, G24→A, R38→K, W47→Y, Q66→R, V67→F, I69→F, A71→L, I75→F, S76→N, Y79→F and Y91→F.

When IGHV3-66*01 and IGHJ1*01 selected as BDB-4G8-D4 heavy chain acceptor sequences, one or more following residues could be back-mutated as follows: V2→I, E6→Q, L11→V, R38→K, W47→Y, V48→M, S49→G, I69→F, R71→L, N73→T, N76→S, L78→A, M82→L and Y91→F.

When IGKV1D-13*01 and IGKJ2*01 selected as BDB-4G8-D4 light chain acceptor sequences, one or more of the following residues could be back-mutated as follows: I2→T, A43→Q and Y87→F with or without one residue deletion (S10).

When IGKV3-11*01 and IGKJ2*01 selected as BDB-4G8-D4 light chain acceptor sequences, one or more of the following residues could be back-mutated as follows: E1→D, I2→T, I58→V, and Y87→F.

When IGKV3-15*01 and IGKJ5*01 or IGKJ5*01 selected as BDB-4G8-D4 light chain acceptor sequences, one or more of the following residues could be back-mutated as follows: E1→D, I2→T, M4→L, A9→S, L13→A, L21→I, R45→K, I58→V, A60→S, G66→R, E70→D, E79→Q and Y87→F.

When IGKV1-39*01 and IGKJ1*01 selected as BDB-4G8-D4 light chain acceptor sequences, one or more of the following residues could be back-mutated as follows: I2→T, M4→L, T22→S, and Y87→F.

Example 6.2.3.2: BEW-9A8-E2

When IGHV7-81*01 and IGHJ1*01 selected as BEW-9A8-E2 heavy chain acceptor sequences, one or more of the following residues could be back-mutated as follows: Q1→E V2→I, P38→K, W47→Y, M71→L, Y90→F and Y91→F with or without CDR change T28→S.

When IGHV1-18*01 and IGHJ1*01 selected as BEW-9A8-E2 heavy chain acceptor sequences, one or more of the following residues could be back-mutated as follows: Q1→E, V2→I, R38→K, W47→Y, V67→F, M69→F, T71→L, Y90→F and Y91→F.

When IGHV7-4-1*01 and IGHJ1*01 selected as BEW-9A8-E2 heavy chain acceptor sequences, one or more of the following residues could be back-mutated as follows: Q1→E, V2→I, R38→K, W47→Y, Y90→F, Y91→F.

When IGKV6-21*01 and IGKJ2*01 selected as BEW-9A8-E2 light chain accepter sequences, one or more of the following residues could be back-mutated as follows: I2→T, S434Q, K49→H and Y87→F. Additional mutations include the following: F10 deletion.

When IGKV1-39*01 and IGKJ2*01 selected as BEW-9A8-E2 light chain accepter sequences, one or more of the following residues could be back-mutated as follows: I2→T, M4→L, A43→Q, Y49→H and Y87→F. Additional mutations include the following: S10 deletion.

When IGKV3-11*01 and IGKJ2*01 selected as BEW-9A8-E2 light chain acceptor sequences, one or more of the following residues could be back-mutated as follows: I2→T, Y49→H, I58→V, V85→T, and Y87→F.

When IGKV1-13*01 and IGKJ2*01 selected as BEW-9A8-E2 light chain acceptor sequences, one or more of the following residues could be back-mutated as follows: I2→T, T22→S, Y49→H, Y87→F.

Example 6.2.3.3: BEW-6C2-C8

When IGHV3-7*01 and IGHJ3*01 selected as BEW-6C2-C8 heavy chain acceptor sequences, one or more of the following residues could be back-mutated as follows: V37→I, V48→M and R94→A.

When IGKV3-11*01 and IGKJ2*01 selected as BEW-6C2-C8 light chain acceptor sequences, one or more of the following residues could be back-mutated as follows: F71→Y and Y87→F.

When IGKV1-39*01 and IGKJ2*01 selected as BEW-6C2-C8 light chain acceptor sequence, one or more of the following residues could be back-mutated as follows: M4→L, V58→I, F71→Y and Y87→F.

Example 6.2.3.4: BEW-9D2-E8

When IGHV7-81*01 and IGHJ4*01 selected as BEW-9D2-E8 heavy chain acceptor sequences, one or more of the following residues could be back-mutated as follows: Q1→E, V2→I, P38→K, Q39→L, W47→Y, M48→L, M71→L and Y91→F with or without CDR change T28→S.

When IGHV1-18*01 and IGHJ4*01 selected as BEW-9D2-E8 heavy chain acceptor sequences, one or more of the following residues could be back-mutated as follows: Q1→E, V2→I, R38→K, Q39→L, W47→Y, M48→L, V67→F, M69→F, T71→L, M80→L and Y91→F.

When IGKV3-11*01 and IGKJ2*01 selected as BEW-9D2-E8 light chain acceptor sequences, one or more of the following residues could be back-mutated as follows: I2→T, A43→Q, I58→V and Y87→F. Additional mutations include the following: T10 deletion.

When IGKV1-39*01 and IGKJ2*01 selected as BEW-9D2-E8 light chain acceptor sequences, one or more of the following residues could be back-mutated as follows: I2→T, M4→L, A43→Q and Y87→F. Additional mutations include the following: T10 deletion.

Example 6.2.3.5: BEW-9E3-B9

When IGHV7-81*01 and IGHJ4*01 selected as BEW-9E3-B9 heavy chain acceptor sequences, one or more of the following residues could be back-mutated as follows: Q1E, V2→I, W47→Y, M71→L and Y91→F with or without CDR change T28→S.

When IGHV1-18*01 and IGHJ4*01 selected as BEW-9E3-B9 heavy chain acceptor sequences, one or more of the following residues could be back-mutated as follows: Q1→E, V2→I, W47→Y, V67→F, M69→F, T71→L and Y91→F.

When IGKV3-11*01 and IGKJ2*01 selected as BEW-9E3-B9 light chain acceptor sequences, one or more of the following residues could be back-mutated as follows: I2→T, A43→Q, I58→V and Y87→F. Additional mutations include the following: S10 deletion.

When IGKV1-39*01 and IGKJ2*01 selected as BEW-9E3-B9 light chain acceptor sequences, one or more of the following residues could be back-mutated as follows: I2→T, M4→L, A43→Q and Y87→F. Additional mutations include the following: S10 deletion.

Example 6.2.3.6: BEW-5C3

When IGHV7-4-1*01 and IGHJ1*01 selected as BEW-5C3 heavy chain accepter sequences, one or more of the following residues could be back-mutated as follows: V2→I, R38→K, W47→Y, Y90→F, Y91→F.

When IGHV1-69*01 and IGHJ1*01 selected as BEW-5C3 heavy chain accepter sequences, one or more of the following residues could be back-mutated as follows: V67→F, I69→F, A71→L. Additional mutations include the following: V2→I, R38→K, W47→Y, T68→V, M80→L, Y90→F, Y91→F.

When IGKV3-11*01 and IGKJ4*01 selected as BEW-5C3 light chain accepter sequences, one or more of the following residues could be back-mutated as follows: E1→D, I2→T, Y36→F, Y87→F. Additional mutations include the following: A43→Q, I58→V, C34→S (CDR change).

When IGKV1-13*01 and IGKJ4*01 selected as BEW-5C3 light chain accepter sequences, one or more of the following residues could be back-mutated as follows: A1→D, I2→T, T22→S, Y36→F, A43→Q, Y87→F with CDR change C34→S.

Example 6.2.3.7: BEW-9E10

When IGHV7-4-1*01 and IGHJ1*01 selected as BEW-9E10 heavy chain acceptor sequences, one or more of the following residues could be back-mutated as follows: V2→I, R38→K, W47→Y, Y91→F.

When IGHV1-69*06 and IGHJ1*01 selected as BEW-9E10 heavy chain acceptor sequences, one or more of the following residues could be back-mutated as follows: V67→F, I69→F. Additional mutations include the following: V2→I, R38→K, W47→Y, Y91→F.

When IGKV1-27*01 and IGKJ2*01 selected as BEW-9E10 light chain acceptor sequences, one or more of the following residues could be back-mutated as follows: Q3→R, V43→S, F71→Y, Y87→F. Additional mutations include the following: T22→E, T72→S.

Example 6.2.3.8: BEW-1B10

When IGHV3-7*01 and IGHJ6*01 selected as BEW-1B10 heavy chain acceptor sequences, one or more of the following residues could be back-mutated as follows: V37→F, I69→V. Additional mutations include the following: N76→S, S77→T.

When IGKV1-39*01 and IGKJ4*01 selected as BEW-1B10 light chain acceptor sequences, one or more of the following residues could be back-mutated as follows: A43→S, F71→Y. Additional mutations include the following: L47→V.

Example 6.2.3.9: BEW-1E3

When IGHV7-4-1*01 and IGHJ1*01 selected as BEW-1E3 heavy chain acceptor sequences, one or more of the following residues could be back-mutated as follows: V2→I, R38→K, W47→Y, Y91→F.

When IGHV1-18*01 and IGHJ1*01 selected as BEW-1E3 heavy chain acceptor sequences, one or more of the following residues could be back-mutated as follows: V67→F, M69→F, T71→L. Additional mutations include the following: V2→I, R38→K, W47→Y, Y91→F.

When IGKV3-11*01 and IGKJ2*01 selected as BEW-1E3 light chain acceptor sequences, one or more of the following residues could be back-mutated as follows: I58→V, Y87→F. Additional mutations include the following: I2→T, A43→Q.

When IGKV1-13*01 and IGKJ2*01 selected as BEW-1E3 light chain acceptor sequences, one or more of the following residues could be back-mutated as follows: Y87→F. Additional mutations include the following: I2→T, T22→S, A43→Q.

Example 6.2.4: Generation of Humanized Antibodies to VEGF Containing Framework Back-Mutations in CDR-Grafted Antibodies The following humanized variable regions of the murine monoclonal VEGF antibodies were cloned into IgG expression vectors for functional characterization.

Example 6.2.4.1: BDB-4G8-D4

TABLE 2.4.1

Sequences of Humanized BDB-4G8-D4 Variable Regions

| SEQ ID NO: | Protein region | Sequence 12345678901234567890123456789 0 |
|---|---|---|
| 654 | hBDB-4G8-D4VH.1z | QVQLVQSGSELKKPGASVKVSCKASGYTFT NYGMYWVRQAPGQGLEWMGWINTETGKPTY ADDFKGRFVFSLDTSVSTAYLQISSLKAED TAVYYCARTNYYYRSYIFYFDYWGQGTMVT VSS |
| 655 | hBDB-4G8-D4VH.1 | EVQLVQSGSELKKPGASVKVSCKASGYTFT NYGMYWVRQAPGQGLEWMGWINTETGKPTY ADDFKGRFVFSLDTSVSTAYLQISSLKAED TAVYYCARTNYYYRSYIFYFDYWGQGTMVT VSS |
| 656 | hBDB-4G8-D4VH.1a | EIQLVQSGSELKKPGASVKVSCKASGYTFT NYGMYWVRQAPGQGLEYMGWINTETGKPTY ADDFKGRFVFSLDTSVSTAYLQISSLKAED TAVYFCARTNYYYRSYIFYFDYWGQGTMVT VSS |
| 657 | hBDB-4G8-D4VH.1b | EVQLVQSGSELKKPGASVKVSCKASGYTFT NYGMYWVRQAPGQGLEYMGWINTETGKPTY ADDFKGRFVFSLDTSVSTAYLQISSLKAED TAVYYCARTNYYYRSYIFYFDYWGQGTMVT VSS |
| 658 | hBDB-4G8-D4VH.2z | QVQLVQSGAEVKKPGASVKVSCKASGYTFT NYGMYWVRQAPGQGLEWMGWINTETGKPTY ADDFKGRVTMTTDTSTSTAYMELRSLRSDD TAVYYCARTNYYYRSYIFYFDYWGQGTMVT VSS |
| 659 | hBDB-4G8-D4VH.2 | EVQLVQSGAEVKKPGASVKVSCKASGYTFT NYGMYWVRQAPGQGLEWMGWINTETGKPTY ADDFKGRVTMTTDTSTSTAYMELRSLRSDD TAVYYCARTNYYYRSYIFYFDYWGQGTMVT VSS |
| 660 | hBDB-4G8-D4VH.2a | EIQLVQSGAEVKKPGASVKVSCKASGYTFT NYGMYWVRQAPGQGLEYMGWINTETGKPTY ADDFKGRFTFTLDTSTSTAYMELRSLRSDD TAVYFCARTNYYYRSYIFYFDYWGQGTMVT VSS |
| 661 | hBDB-4G8-D4VH.2b | EVQLVQSGAEVKKPGASVKVSCKASGYTFT NYGMYWVRQAPGQGLEYMGWINTETGKPTY ADDFKGRVTMTLDTSTSTAYMELRSLRSDD TAVYYCARTNYYYRSYIFYFDYWGQGTMVT VSS |
| 662 | hBDB-4G8-D4VH.v3 | EIQLVQSGTEVKKPGESLKISCKASGYTFT NYGMYWVKQMPGKGLEYMCWINTETGKPTY ADDFKGRFTFSLDKSFNTAFLQWSSLKASD TAMYFCARTNYYYRSYIFYFDYWGQGTMVT VSS |
| 663 | hBDB-4G8-D4VH.v4 | EIQLVQSGGGVVQPGGSLRLSCAASGYTFT NYGMYWVKQAPGKGLEYMCWINTETGKPTY ADDFKGRFTFSLDTSKSTAYLQLNSLRAED TAVYFCARTNYYYRSYIFYFDYWGQGTLVT VSS |
| 664 | hBDB-4G8-D4VH.v5 | EVQLVESGGGLVQPGGSLRLSCAASGYTFT NYGMYWVKQAPGKGLEYMGWINTETGKPTY ADDFKGRFTFSLDTSKSTAYLQMNSLRAED TAVYFCARTNYYYRSYIFYFDYWGQGTLVT VSS |
| 665 | hBDB-4G8-D4VL.1 | AIQLTQSPSSLSASVGDRVTITCRASESVS THMHWYQQKPGKAPKLLIYGASNLESGVPS RFSGSGSGTDFTLTISSLQPEDFATYYCQQ SWNDPFTFGQGTKLEIK |

TABLE 2.4.1-continued

Sequences of Humanized BDB-4G8-D4 Variable Regions

| SEQ ID NO: | Protein region | Sequence<br>123456789012345678901234567890 |
|---|---|---|
| 666 | hBDB-4G8-D4VL.1a | ATQLTQSPSLSASVGDRVTITCRASESVST<br>HMHWYQQKPGKQPKLLIYGASNLESGVPSR<br>FSGSGSGTDFTLTISSLQPEDFATYFCQQS<br>WNDPFTFGQGTKLEIK |
| 667 | hBDB-4G8-D4VL.1b | ATQLTQSPSLSASVGDRVTITCRASESVST<br>HMHWYQQKPGKAPKLLIYGASNLESGVPSR<br>FSGSGSGTDFTLTISSLQPEDFATYYCQQS<br>WNDPFTFGQGTKLEIK |
| 668 | hBDB-4G8-D4VL.1c | ATQLTQSPSSLSASVGDRVTITCRASESVS<br>THMHWYQQKPGKAPKLLIYGASNLESGVPS<br>RFSGSGSGTDFTLTISSLQPEDFATYYCQQ<br>SWNDPFTFGQGTKLEIK |
| 669 | hBDB-4G8-D4VL.v2 | DTVLTQSPATLSLSPGERATLSCRASESVS<br>THMHWYQQKPGQAPRLLIYGASNLESGVPA<br>RFSGSGSGTDFTLTISSLEPEDFAVYFCQQ<br>SWNDPFTFGQGTKLEIK |
| 670 | hBDB-4G8-D4VL.v3 | ETVLTQSPATLSVSPGERATLSCRASESVS<br>THMHWYQQKPGQAPRLLIYGASNLESGVPA<br>RFSGSGSGTDFTLTISSLQSEDFAVYFCQQ<br>SWNDPFTFGQGTRLEIK |
| 671 | hBDB-4G8-D4VL.v4 | DTVLTQSPSTLSASPGERATISCRASESVS<br>THMHWYQQKPGQAPKLLIYGASNLESGVPS<br>RFSGSRSGTDFTLTISSLQPEDFAVYFCQQ<br>SWNDPFTFGQGTKVEIK |
| 672 | hBDB-4G8-D4VL.v5 | DTQLTQSPSSLSASVGDRVTISCRASESVS<br>THMHWYQQKPGKAPKLLIYGASNLESGVPS<br>RFSGSGSGTDFTLTISSLQPEDFATYFCQQ<br>SWNDPFTFGQGTKVEIK | hBDB-4G8-D4VH.1z is a CDR-grafted, humanized BDB-4G8-D4 VH containing IGHV7-4-1*02 and IGHJ3*01 framework sequences.

hBDB-4G8-D4VH.1 is based on .1z with a Q1E change to prevent pyroglutamate formation.

hBDB-4G8-D4VH.1a is a humanized design based on .1 and contains three proposed framework back-mutations (V2I, W47Y and Y91F).

hBDB-4G8-D4VH.1b is an intermediate design between .1 and .1a and only has one back-mutations W47Y.

hBDB-4G8-D4VH.2z is a CDR-grafted, humanized BDB-4G8-D4 VH containing IGHV1-18*01 and IGHJ3*01 framework sequences.

hBDB-4G8-D4VH.2 is based on .2z with a Q1E change to prevent pyroglutamate formation.

hBDB-4G8-D4VH.2a is a humanized design based on .2 and contains six proposed framework back-mutations (V2I, W47Y, V67F, M69F, T71L and Y91F).

hBDB-4G8-D4VH.2b is an intermediate design between .2 and .2a and only has two proposed framework back-mutations (W47Y and T71L).

hBDB-4G8-D4VH.v3 is a humanized BDB-4G8-D4 VH containing IGHV5-51*01 and IGHJ3*01 framework sequences with thirteen proposed framework back-mutations (V2I, A9T, G24A, R38K, W47Y, Q66R, V67F, I69F, A71L, I75F, S76N, Y79F and Y91F).

hBDB-4G8-D4VH.v4 is a humanized BDB-4G8-D4 VH containing IGHV3-66*01 and IGHJ1*01 framework sequences with thirteen proposed framework back-mutations (V2I, E6Q, L11V, W47Y, V48M, S49G, I69F, R71L, N73T, N76S, L78A, M82L and Y91F).

hBDB-4G8-D4VH.v5 is a humanized BDB-4G8-D4 containing IGHV3-66*01 and IGHJ1*01 framework sequences with ten proposed framework back-mutations (R38K, W47Y, V48M, S49G, I69F, R71L, N73T, N76S, L78A and Y91F).

hBDB-4G8-D4VL.1 is a CDR-grafted humanized BDB-4G8-D4 VL containing IGKV1D-13*01 and IGKJ2*01 framework sequences.

hBDB-4G8-D4VL.1a is a humanized design based on .1 with 3 proposed framework back-mutations (I2T, A43Q and Y87F) and one residue deletion (S10).

hBDB-4G8-D4VL.1b is an intermediate design between .1 and .1a with only one proposed framework back-mutation 12T.

hBDB-4G8-D4VL.1c is a humanized design based on .1b with one residue insertion (S10).

hBDB-4G8-D4VL.v2 is a humanized BDB-4G8-D4 VL containing IGKV3-11*01 and IGKJ2*01 framework sequences with four proposed framework back-mutations (E1D, I2T, I58V, and Y87F).

hBDB-4G8-D4VL.v3 is a humanized BDB-4G8-D4 VL design containing IGKV3-15*01 and IGKJ5*01 framework sequences with five proposed framework back-mutations (I2T, M4L, I58V, E70D, and Y87F).

hBDB-4G8-D4VL.v4 is a humanized BDB-4G8-D4 VL containing IGKV3-15*01 and IGKJ1*01 framework sequences with eleven proposed framework back-mutations (E1D, I2T, A9S, L13A, L21I, R45K, I58V, A60S, G66R, E79Q, and Y87F).

hBDB-4G8-D4VL.v5 is a humanized BDB-4G8-D4 VL containing IGKV1-39*01 and IGKJ1*01 framework sequences with four proposed framework back-mutations (I2T, M4L, T22S, and Y87F).

Example 6.2.4.2: BEW-9A8-E2

TABLE 2.4.2

Sequences of Humanized BEW-9A8-E2 Variable Regions

| SEQ ID NO: | Protein region | Sequence<br>123456789012345678901234567890 |
|---|---|---|
| 673 | hBEW-9A8-E2VH.1z | QVQLVQSGHEVKQPGASVKVSCKASGYTFT<br>NYGMYWVPQAPGQGLEWMGWINTETGKPIY<br>ADDFKGRFVFSMDTSASTAYLQISSLKAED<br>MAMYYCARVDYDGSFWFAYWGQGTLVTVSS |
| 674 | hBEW-9A8-E2VH.1 | EVQLVQSGHEVKQPGASVKVSCKASGYTFT<br>NYGMYWVPQAPGQGLEWMGWINTETGKPIY<br>ADDFKGRFVFSMDTSASTAYLQISSLKAED<br>MAMYYCARVDYDGSFWFAYWGQGTLVTVSS |
| 675 | hBEW-9A8-E2VH.1a | EIQLVQSGHEVKQPGASVKVSCKASGYTFT<br>NYGMYWVKQPGQGLEYMGWINTETGKPIY<br>ADDFKGRFVFSLDTSASTAYLQISSLKAED<br>MAMFFCARVDYDGSFWFAYWGQGTLVTVSS |
| 676 | hBEW-9A8-E2VH.1b | EVQLVQSGHEVKQPGASVKVSCKASGYTFT<br>NYGMYWVPQAPGQGLEYMGWINTETGKPIY<br>ADDFKGRFVFSLDTSASTAYLQISSLKAED<br>MAMFYCARVDYDGSFWFAYWGQGTLVTVSS |
| 677 | hBEW-9A8-E2VH.1c | EVQLVQSGHEVKQPGASVKVSCKASGYSFT<br>NYGMYWVPQAPGQGLEYMGWINTETGKPIY<br>ADDFKGRFVFSLDTSASTAYLQISSLKAED<br>MAMFYCARVDYDGSFWFAYWGQGTLVTVSS |

TABLE 2.4.2-continued

Sequences of Humanized BEW-9A8-E2 Variable Regions

| SEQ ID NO: | Protein region | Sequence 123456789012345678901234567890 |
|---|---|---|
| 678 | hBEW-9A8-E2VH.2z | QVQLVQSGAEVKKPGASVKVSCKASGYTFT NYGMYWVRQAPGQGLEWMGWINTETGKPIY ADDFKGRVTMTTDTSTSTAYMELRSLRSDD TAVYYCARVDYDGSFWFAYWGQGTLVTVSS |
| 679 | hBEW-9A8-E2VH.2 | EVQLVQSGAEVKKPGASVKVSCKASGYTFT NYGMYWVRQAPGQGLEWMGWINTETGKPIY ADDFKGRVTMTTDTSTSTAYMELRSLRSDD TAVYYCARVDYDGSFWFAYWGQGTLVTVSS |
| 680 | hBEW-9A8-E2VH.2a | EIQLVQSGAEVKKPGASVKVSCKASGYTFT NYGMYWVKQAPGQGLEYMGWINTETGKPIY ADDFKGRFTFTLDTSTSTAYMELRSLRSDD TAVFFCARVDYDGSFWFAYWGQGTLVTVSS |
| 681 | hBEW-9A8-E2VH.2b | EVQLVQSGAEVKKPGASVKVSCKASGYTFT NYGMYWVRQAPGQGLEWMGWINTETGKPIY ADDFKGRVTMTLDTSTSTAYMELRSLRSDD TAVFFCARVDYDGSFWFAYWGQGTLVTVSS |
| 682 | hBEW-9A8-E2VH.2c | EIQLVQSGAEVKKPGASVKVSCKASGYTFT NYGMYWVKQAPGQGLEYMGWINTETGKPIY ADDFKGRFTFTLDTSTSTAYMELRSLRSDD TAVYYCARVDYDGSFWFAYWGQGTLVTVSS |
| 683 | hBEW-9A8-E2VH.2d | EIQLVQSGAEVKKPGASVKVSCKASGYTFT NYGMYWVRQAPGQGLEWMGWINTETGKPIY ADDFKGRFTFTLDTSTSTAYMELRSLRSDD TAVYYCARVDYDGSFWFAYWGQGTLVTVSS |
| 684 | hBEW-9A8-E2VH.3z | QVQLVQSGSELKKPGASVKVSCKASGYTFT NYGMYWVRQAPGQGLEWMGWINTETGKPIY ADDFKGRFVFSLDTSVSTAYLQISSLKAED TAVYYCARVDYDGSFWFAYWGQGTLVTVSS |
| 685 | hBEW-9A8-E2VH.3 | EVQLVQSGSELKKPGASVKVSCKASGYTFT NYGMYWVRQAPGQGLEWMGWINTETGKPIY ADDFKGRFVFSLDTSVSTAYLQISSLKAED TAVYYCARVDYDGSFWFAYWGQGTLVTVSS |
| 686 | hBEW-9A8-E2VH.3a | EIQLVQSGSELKKPGASVKVSCKASGYTFT NYGMYWVKQAPGQGLEYMGWINTETGKPIY ADDFKGRFVFSLDTSVSTAYLQISSLKAED TAVYYCARVDYDGSFWFAYWGQGTLVTVSS |
| 687 | hBEW-9A8-E2VH.3b | EIQLVQSGSELKKPGASVKVSCKASGYTFT NYGMYWVRQAPGQGLEWMGWINTETGKPIY ADDFKGRFVFSLDTSVSTAYLQISSLKAED TAVYYCARVDYDGSFWFAYWGQGTLVTVSS |
| 688 | hBEW-9A8-E2VH.3c | EIQLVQSGSELKKPGASVKVSCKASGYTFT NYGMYWVRQAPGQGLEWMGWINTETGKPIY ADDFKGRFVFSLDTSVSTAYLQISSLKAED TAVFFCARVDYDGSFWFAYWGQGTLVTVSS |
| 689 | hBEW-9A8-E2VL.1 | EIVLTQSPDFQSVTPKEKVTITCRASESVS TVIHWYQQKPDQSPKLLIKGASNLESGVPS RFSGSGSGTDFTLTINSLEAEDAATYYCQQ HWNDPPTFGQGTKLEIK |
| 690 | hBEW-9A8-E2VL.1a | ETVLTQSPDFQSVTPKEKVTITCRASESVS TVIHWYQQKPDQQPKLLIHGASNLESGVPS RFSGSGSGTDFTLTINSLEAEDAATYFCQQ HWNDPPTFGQGTKLEIK |
| 691 | hBEW-9A8-E2VL.1b | ETVLTQSPDFQSVTPKEKVTITCRASESVS TVIHWYQQKPDQSPKLLIHGASNLESGVPS RFSGSGSGTDFTLTINSLEAEDAATYYCQQ HWNDPPTFGQGTKLEIK |
| 692 | hBEW-9A8-E2VL.1c | ETVLTQSPDFQSVTPKEKVTITCRASESVST VIHWYQQKPDQSPKLLIHGASNLESGVPSR FSGSGSGTDFTLTINSLEAEDAATYYCQQH WNDPPTFGQGTKLEIK |
| 693 | hBEW-9A8-E2VL.2 | DIQMTQSPSSLSASVGDRVTITCRASESVS TVIHWYQQKPGKAPKLLIYGASNLESGVPS RFSGSGSGTDFTLTISSLQPEDFATYYCQQ HWNDPPTFGQGTKLEIK |
| 694 | hBEW-9A8-E2VL.2a | DTQLTQSPSSLSASVGDRVTITCRASESVS TVIHWYQQKPGKQPKLLIHGASNLESGVPS RFSGSGSGTDFTLTISSLQPEDFATYFCQQ HWNDPPTFGQGTKLEIK |
| 695 | hBEW-9A8-E2VL.2b | DTQMTQSPSSLSASVGDRVTITCRASESVS TVIHWYQQKPGKAPKLLIHGASNLESGVPS RFSGSGSGTDFTLTISSLQPEDFATYYCQQ HWNDPPTFGQGTKLEIK |
| 696 | hBEW-9A8-E2VL.2c | DTQMTQSPSSLSASVGDRVTITCRASESVST VIHWYQQKPGKAPKLLIHGASNLESGVPSR FSGSGSGTDFTLTISSLQPEDFATYYCQQH WNDPPTFGQGTKLEIK |
| 697 | hBEW-9A8-E2VL.3 | EIVLTQSPATLSLSPGERATLSCRASESVS TVIHWYQQKPGQAPRLLIYGASNLESGIPA RFSGSGSGTDFTLTISSLEPEDFAVYYCQQ HWNDPPTFGQGTKLEIK |
| 698 | hBEW-9A8-E2VL.3a | ETVLTQSPATLSLSPGERATLSCRASESVS TVIHWYQQKPGQAPRLLIHGASNLESGVPA RFSGSGSGTDFTLTISSLEPEDFATYFCQQ HWNDPPTFGQGTKLEIK |
| 699 | hBEW-9A8-E2VL.3b | ETVLTQSPATLSLSPGERATLSCRASESVS TVIHWYQQKPGQAPRLLIYGASNLESGIPA RFSGSGSGTDFTLTISSLEPEDFAVYFCQQ HWNDPPTFGQGTKLEIK |
| 700 | hBEW-9A8-E2VL.3c | ETVLTQSPATLSLSPGERATLSCRASESVS TVIHWYQQKPGQAPRLLIYGASNLESGIPA RFSGSGSGTDFTLTISSLEPEDFAVYYCQQ HWNDPPTFGQGTKLEIK |
| 701 | hBEW-9A8-E2VL.4 | AIQLTQSPSSLSASVGDRVTITCRASESVS TVIHWYQQKPGKAPKLLIYGASNLESGVPS RFSGSGSGTDFTLTISSLQPEDFATYYCQQ HWNDPPTFGQGTKLEIK |
| 702 | hBEW-9A8-E2VL.4a | ATQLTQSPSSLSASVGDRVTISCRASESVS TVIHWYQQKPGKAPKLLIHGASNLESGVPS RFSGSGSGTDFTLTISSLQPEDFATYFCQQ HWNDPPTFGQGTKLEIK |
| 703 | hBEW-9A8-E2VL.4b | ATQLTQSPSSLSASVGDRVTITCRASESVS TVIHWYQQKPGKAPKLLIYGASNLESGVPS RFSGSGSGTDFTLTISSLQPEDFATYFCQQ HWNDPPTFGQGTKLEIK |
| 704 | hBEW-9A8-E2VL.4c | ATQLTQSPSSLSASVGDRVTITCRASESVS TVIHWYQQKPGKAPKLLIYGASNLESGVPS RFSGSGSGTDFTLTISSLQPEDFATYYCQQ HWNDPPTFGQGTKLEIK | hBEW-9A8-E2VH.1z is a CDR-grafted, humanized BEW-9A8-E2 VH containing IGHV7-81*01 and IGHJ1*01 framework sequences.

hBEW-9A8-E2VH.1 is based on .1z with a Q1E change to prevent pyroglutamate formation.

hBEW-9A8-E2VH.1a is a humanized design based on .1 and contains six proposed framework back-mutations (V2I, P38K, W47Y, M71L, Y90F and Y91F).

hBEW-9A8-E2VH.1b is an intermediate design between .1 and .1a and only has three proposed framework back-mutations (W47Y, M71L and Y90F).

hBEW-9A8-E2VH.1c is based on .1b with additional one CDR germlining change T28S to improve identity to human germline sequence.

hBEW-9A8-E2VH.2z is a CDR-grafted, humanized BEW-9A8-E2 VH containing IGHV1-18*01 and IGHJ1*01 framework sequences.

hBEW-9A8-E2VH.2 is based on .2z with a Q1E change to prevent pyroglutamate formation.

hBEW-9A8-E2VH.2a is a humanized design based on .2 and contains eight proposed framework back-mutations (V2I, R38K, W47Y, V67F, M69F, T71L, Y90F and Y91F).

hBEW-9A8-E2VH.2b is an intermediate design between .2 and .2a and contains three back-mutations (W47Y, M71L and Y90F).

hBEW-9A8-E2VH.2c (hBEW-9A8VH.4a) is an intermediate design between .2 and .2a and contains six proposed framework back-mutations (V2I, R38K, W47Y, V67F, M69F, and T71L).

hBEW-9A8-E2VH.2d (hBEW-9A8VH.4b) is an intermediate design between .2 and .2a contains four proposed framework back-mutations (V2I, V67F, M69F, and T71L).

hBEW-9A8VH.3z is a CDR-grafted, humanized BEW-9A8 VH containing IGHV7-4-1*01 and IGHJ1*01 framework sequences.

hBEW-9A8VH.3 is based on .3z with a Q1E change to prevent pyroglutamate formation.

hBEW-9A8VH.3a is a humanized design based on .3 and contains 3 proposed framework back-mutations (V2I, R38K, W47Y).

hBEW-9A8VH.3b is an intermediate design between .3 and .3a and contains 1 proposed framework back-mutations: V2I.

hBEW-9A8VH.3c is a humanized design based on .3 and contains 5 proposed framework back-mutations (V2I, R38K, W47Y, Y90F, Y91F).

hBEW-9A8-E2VL.1 is a CDR-grafted humanized BEW-9A8-E2 VL containing IGKV6-21*01 and IGKJ2*01 framework sequences.

hBEW-9A8-E2VL.1a is a humanized design based on .1 with four proposed framework back-mutations (I2T, S43Q, K49H and Y87F).

hBEW-9A8-E2VL.1b is an intermediate design between .1 and .1a with only two proposed framework back-mutation (I2T and K49H).

hBEW-9A8-E2VL.1c is based on .1b with one residue deletion of F10.

hBEW-9A8-E2VL.2 is a CDR-grafted humanized BEW-9A8-E2 VL containing IGKV1-39*01 and IGKJ2*01 framework sequences.

hBEW-9A8-E2VL.2a is a humanized design based on .2 with five proposed framework back-mutations (I2T, M4L, A43Q, Y49H and Y87F).

hBEW-9A8-E2VL.2b is an intermediate design between .1 and .1a with only two proposed framework back-mutation (I2T and Y49H).

hBEW-9A8-E2VL.2c is based on .2b with one residue deletion of S10.

hBEW-9A8VL.3 is a CDR-grafted humanized BEW-9A8 VL containing IGKV3-11*01 and IGKJ2*01 framework sequences.

hBEW-9A8VL.3a is a humanized design based on .3 and contains 5 proposed framework back-mutations: (I2T, Y49H, I58V, V85T, Y87F).

hBEW-9A8VL.3b is an intermediate design between .3 and 3a. It contains 2 proposed framework back-mutations: (I2T, Y87F).

hBEW-9A8VL.3c is a design based on .3b and contains 1 proposed framework back-mutations: I2T.

hBEW-9A8VL.4 is a CDR-grafted, humanized BEW-9A8 VL containing IGKV1-13*01 and IGKJ2*01 framework sequences.

hBEW-9A8VL.4a is a humanized design based on .4 and contains 4 proposed framework back-mutations: I2T, T22S, Y49H, Y87F.

hBEW-9A8VL.4b is an intermediate design between .4 and 4a. It contains 2 proposed framework back-mutations: I2T, Y87F.

hBEW-9A8VL.4c is a design based on .4b and eliminated Carter residue back-mutations. It contains 1 proposed framework back-mutations: I2T.

Example 6.2.4.3: BEW-6C2-C8

TABLE 2.4.3

Sequences of Humanized BEW-6C2-C8 Variable Regions

| SEQ ID NO: | Protein region | Sequence 12345678901234567890123456 7890 |
|---|---|---|
| 705 | hBEW-6C2-C8VH.1 | EVQLVESGGGLVQPGGSLRLSCAASGFTFS YYGMHWVRQAPGKGLEWVALIYYDSSKMYY ADSVKGRFTISRDNAKNSLYLQMNSLRAED TAVYYCARGGTAPVYWGQGTMVTVSS |
| 706 | hBEW-6C2-C8VH.1a | EVQLVESGGGLVQPGGSLRLSCAASGFTFS YYGMHWIRQAPGKGLEWMALIYYDSSKMYY ADSVKGRFTISRDNAKNSLYLQMNSLRAED TAVYYCAAGGTAPVYWGQGTMVTVSS |
| 707 | hBEW-6C2-C8VH.1b | EVQLVESGGGLVQPGGSLRLSCAASGFTFS YYGMHWVRQAPGKGLEWMALIYYDSSKMYY ADSVKGRFTISRDNAKNSLYLQMNSLRAED TAVYYCAAGGTAPVYWGQGTMVTVSS |
| 708 | hBEW-6C2-C8VL.1 | EIVLTQSPATLSLSPGERATLSCKGSQNIA NYLAWYQQKPGQAPRLLIYNTDSLQTGIPA RFSGSGSGTDFTLTISSLEPEDFAVYYCYQ SNNGYTFGQGTKLEIK |
| 709 | hBEW-6C2-C8VL.1a | EIVLTQSPATLSLSPGERATLSCKGSQNIA NYLAWYQQKPGQAPRLLIYNTDSLQTGIPA RFSGSGSGTDYTLTISSLEPEDFAVYFCYQ SNNGYTFGQGTKLEIK |
| 710 | hBEW-6C2-C8VL.2 | DIQMTQSPSSLSASVGDRVTITCKGSQNIA NYLAWYQQKPGKAPKLLIYNTDSLQTGVPS RFSGSGSGTDFTLTISSLQPEDFATYYCYQ SNNGYTFGQGTKLEIK |
| 711 | hBEW-6C2-C8VL.2a | DIQLTQSPSSLSASVGDRVTITCKGSQNIA NYLAWYQQKPGKAPKLLIYNTDSLQTGIPS RFSGSGSGTDYTLTISSLQPEDFATYFCYQ SNNGYTFGQGTKLEIK | hBEW-6C2-C8VH.1 is a CDR-grafted, humanized BEW-6C2-C8 VH containing IGHV3-7*01 and IGHJ3*01 framework sequences.

hBEW-6C2-C8VH.1a is a humanized design based on .1 and contains three proposed framework back-mutations V37I, V48M and R94A.

hBEW-6C2-C8VH.1b is an intermediate design between .1 and .1a and only has two back-mutations V48M and R94A. This design eliminates Carter residue back-mutations.

hBEW-6C2-C8VL.1 is a CDR-grafted humanized BEW-6C2-C8 VL containing IGKV3-11*01 and IGKJ2*01 framework sequences.

hBEW-6C2-C8VL.1a is a humanized design based on .1 with 2 proposed framework back-mutations (F71Y and Y87F).

hBEW-6C2-C8VL.2 is a CDR-grafted humanized BEW-6C2-C8 VL containing IGKV1-39*01 and IGKJ2*01 framework sequences.

hBEW-6C2-C8VL.2a is a humanized design based on .2 with 4 proposed framework back-mutations (M4L, V58I, F71Y and Y87F).

Example 6.2.4.4: BEW-9D2-E8

TABLE 2.4.4

Sequences of Humanized BEW-9D2-E8 Variable Regions

| SEQ ID NO: | Protein region | Sequence 12345678901234567890123456789 |
|---|---|---|
| 712 | hBEW-9D2-E8VH.1z | QVQLVQSGHEVKQPGASVKVSCKASGYTFT NYGMYWVPQAPGQGLEWMGWINTETGKPTY ADDFKGRFVFSMDTSASTAYLQISSLKAED MAMYYCARPSDYYDGFWFAYWGQGTLVTVS S |
| 713 | hBEW-9D2-E8VH.1 | EVQLVQSGHEVKQPGASVKVSCKASGYTFT NYGMYWVPQAPGQGLEWMGWINTETGKPTY ADDFKGRFVFSMDTSASTAYLQISSLKAED MAMYYCARPSDYYDGFWFAYWGQGTLVTVS S |
| 714 | hBEW-9D2-E8VH.1a | EIQLVQSGHEVKQPGASVKVSCKASGYTFT NYGMYWVKLAPGQGLEYLGWINTETGKPTY ADDFKGRFVFSLDTSASTAYLQISSLKAED MAMYFCARPSDYYDGFWFAYWGQGTLVTVS S |
| 715 | hBEW-9D2-E8VH.1b | EVQLVQSGHEVKQPGASVKVSCKASGYTFT NYGMYWVKQAPGQGLEYLGWINTETGKPTY ADDFKGRFVFSLDTSASTAYLQISSLKAED MAMYYCARPSDYYDGFWFAYWGQGTLVTVS S |
| 716 | hBEW-9D2-E8VH.1c | EVQLVQSGHEVKQPGASVKVSCKASGYSFT NYGMYWVKQAPGQGLEYLGWINTETGKPTY ADDFKGRFVFSLDTSASTAYLQISSLKAED MAMYYCARPSDYYDGFWFAYWGQGTLVTVS S |
| 717 | hBEW-9D2-E8VH.2z | QVQLVQSGAEVKKPGASVKVSCKASGYTFT NYGMYWVRQAPGQGLEWMGWINTETGKPTY ADDFKGRVTMTTDTSTSTAYMELRSLRSDD TAVYYCARPSDYYDGFWFAYWGQGTLVTVS S |
| 718 | hBEW-9D2-E8VH.2 | EVQLVQSGAEVKKPGASVKVSCKASGYTFT NYGMYWVRQAPGQGLEWMGWINTETGKPTY ADDFKGRVTMTTDTSTSTAYMELRSLRSDD TAVYYCARPSDYYDGFWFAYWGQGTLVTVS S |
| 719 | hBEW-9D2-E8VH.2a | EIQLVQSGAEVKKPGASVKVSCKASGYTFT NYGMYWVKLAPGQGLEYLGWINTETGKPTY ADDFKGRFTFTLDTSTSTAYLELRSLRSDD TAVYFCARPSDYYDGFWFAYWGQGTLVTVS S |
| 720 | hBEW-9D2-E8VH.2B | EVQLVQSGAEVKKPGASVKVSCKASGYTFT NYGMYWVKQAPGQGLEYLGWINTETGKPTY ADDFKGRVTMTDTSTSTAYLELRSLRSDD TAVYYCARPSDYYDGFWFAYWGQGTLVTVS S |

TABLE 2.4.4-continued

Sequences of Humanized BEW-9D2-E8 Variable Regions

| SEQ ID NO: | Protein region | Sequence 12345678901234567890123456789 |
|---|---|---|
| 721 | hBEW-9D2-E8VL.1 | EIVLTQSPATLSLSPGERATLSCRASEWVN SYMHWYQQKPGQAPRLLIYKASNLASGIPA RFSGSGSGTDFTLTISSLEPEDFAVYYCQQ SWNDPLTFGQGTKLEIK |
| 722 | hBEW-9D2-E8VL.1a | ETVLTQSPATLSLSPGERATLSCRASEWVN SYMHWYQQKPGQPRLLIYKASNLASGVPA RFSGSGSGTDFTLTISSLEPEDFAVYFCQQ SWNDPLTFGQGTKLEIK |
| 723 | hBEW-9D2-E8VL.1b | ETVLTQSPATLSLSPGERATLSCRASEWVN SYMHWYQQKPGQAPRLLIYKASNLASGIPA RFSGSGSGTDFTLTISSLEPEDFAVYYCQQ SWNDPLTFGQGTKLEIK |
| 724 | hBEW-9D2-E8VL.2 | DIQMTQSPSSLSASVGDRVTITCRASEWVN SYMHWYQQKPGKAPKLLIYKASNLASGVPS RFSGSGSGTDFTLTISSLQPEDFATYYCQQ SWNDPLTFGQGTKLEIK |
| 725 | hBEW-9D2-E8VL.2a | DTQLTQSPSSLSASVGDRVTITCRASEWVN SYMHWYQQKPGKQPKLLIYKASNLASGVPS RFSGSGSGTDFTLTISSLQPEDFATYFCQQ SWNDPLTFGQGTKLEIK |
| 726 | hBEW-9D2-E8VL.2b | DTQMTQSPSSLSASVGDRVTITCRASEWVN SYMHWYQQKPGKAPKLLIYKASNLASGVPS RFSGSGSGTDFTLTISSLQPEDFATYYCQQ SWNDPLTFGQGTKLEIK | hBEW-9D2-E8VH.1z is a CDR-grafted, humanized BEW-9D2-E8 VH containing IGHV7-81*01 and IGHJ4*01 framework sequences.

hBEW-9D2-E8VH.1 is based on .1z with a Q1E change to prevent pyroglutamate formation.

hBEW-9D2-E8VH.1a is a humanized design based on .1 and contains seven proposed framework back-mutations (V2I, P38K, Q39L, W47Y, M48L, M71L and Y91F).

hBEW-9D2-E8VH.1b is an intermediate design between .1 and .1a and only has four proposed framework back-mutations (P38K, W47Y, M48L, M71L).

BEW-9D2-E8VH.1c is based on .1b with additional one CDR germlining change T28S to improve identity to human germline sequence.

hBEW-9D2-E8VH.2z is a CDR-grafted, humanized BEW-9D2-E8 VH containing IGHV1-18*01 and IGHJ4*01 framework sequences.

hBEW-9D2-E8VH.2 is based on .2z with a Q1E change to prevent pyroglutamate formation.

hBEW-9D2-E8VH.2a is a humanized design based on .2 and contains ten proposed framework back-mutations (V2I, R38K, Q39L, W47Y, M48L, V67F, M69F, T71L, M80L and Y91F).

hBEW-9D2-E8VH.2b is an intermediate design between .2 and .2a and only has five proposed framework back-mutations (R38K, W47Y, M48L, T71L and M80L).

hBEW-9D2-E8VL.1 is a CDR-grafted humanized BEW-9D2-E8 VL containing IGKV3-11*01 and IGKJ2*01 framework sequences.

hBEW-9D2-E8VL.1a is a humanized design based on .1 with four proposed framework back-mutations (I2T, A43Q, I58V and Y87F).

hBEW-9D2-E8VL.1b is an intermediate design between .1 and .1a with one proposed framework back-mutation 12V.

hBEW-9D2-E8VL.2 is a CDR-grafted humanized BEW-9D2-E8 VL containing IGKV1-39*01 and IGKJ2*01 framework sequences.

hBEW-9D2-E8VL.2a is a humanized design based on .2 with four proposed framework back-mutations (I2T, M4L, A43Q and Y87F).

hBEW-9D2-E8VL.2b is an intermediate design between .2 and .2a with one proposed framework back-mutation 12V.

Example 6.2.4.5: BEW-9E3-B9

TABLE 2.4.5

Sequences of Humanized BEW-9E3-B9 Variable Regions

| SEQ ID NO: | Protein region | Sequence 123456789012345678901234567890 |
|---|---|---|
| 727 | hBEW-9E3-B9VH.1z | QVQLVQSGHEVKQPGASVKVSCKASGYTFT NYGMYWVPQAPGQGLEWMGWINTETGKPTY ADDFKGRFVFSMDTSASTAYLQISSLKAED MAMYYCARPSDYYDGFWFPYWGQGTLVTVS S |
| 728 | hBEW-9E3-B9VH.1 | EVQLVQSGHEVKQPGASVKVSCKASGYTFT NYGMYWVPQAPGQGLEWMGWINTETGKPTY ADDFKGRFVFSMDTSASTAYLQISSLKAED MAMYYCARPSDYYDGFWFPYWGQGTLVTVS S |
| 729 | hBEW-9E3-B9VH.1a | EIQLVQSGHEVKQPGASVKVSCKASGYTFT NYGMYWVPQAPGQGLEWMGWINTETGKPTY ADDFKGRFVFSLDTSASTAYLQISSLKAED MAMYFCARPSDYYDGFWFPYWGQGTLVTVS S |
| 730 | hBEW-9E3-B9VH.1b | EVQLVQSGHEVKQPGASVKVSCKASGYTFT NYGMYWVPQAPGQGLEWMGWINTETGKPTY ADDFKGPFVFSLDTSASTAYLQISSLKAED MAMYYCARPSDYYDGFWFPYWGQGTLVTVS S |
| 731 | hBEW-9E3-B9VH.1c | EVQLVQSGHEVKQPGASVKVSCKASGYSFT NYGMYWVPQAPGQGLEWMGWINTETGKPTY ADDFKGRFVFSLDTSASTAYLQISSLKAED MAMYYCARPSDYYDGFWFPYWGQGTLVTVS S |
| 732 | hBEW-9E3-B9VH.2z | QVQLVQSGAEVKKPGASVKVSCKASGYTFT NYGMYWVRQAPGQGLEWMGWINTETGKPTY ADDFKGPVTMTTDTSTSTAYMELRSLPSDD TAVYYCARPSDYYDGFWFPYWGQGTLVTVS S |
| 733 | hBEW-9E3-B9VH.2 | EVQLVQSGAEVKKPGASVKVSCKASGYTFT NYGMYWVRQAPGQGLEWMGWINTETGKPTY ADDFKGRVTMTTDTSTSTAYMELRSLRSDD TAVYYCARPSDYYDGFWFPYWGQGTLVTVS S |
| 734 | hBEW-9E3-B9VH.2a | EIQLVQSGAEVKKPGASVKVSCKASGYTFT NYGMYWVRQAPGQGLEWMGWINTETGKPTY ADDFKGRFTFTLDTSTSTAYMELRSLRSDD TAVYFCARPSDYYDGFWFPYWGQGTLVTVS S |
| 735 | hBEW-9E3-B9VH.2b | EVQLVQSGAEVKKPGASVKVSCKASGYTFT NYGMYWVRQAPGQGLEYMGWINTETGKPTY ADDFKGRVTMTLDTSTSTAYMELRSLRSDD TAVYYCARPSDYYDGFWFPYWGQGTLVTVS S |

TABLE 2.4.5-continued

Sequences of Humanized BEW-9E3-B9 Variable Regions

| SEQ ID NO: | Protein region | Sequence 123456789012345678901234567890 |
|---|---|---|
| 736 | hBEW-9E3-B9VL.1 | EIVLTQSPATLSLSPGERATLSCRASEGVN SYMHWYQQKPGQAPRLLIYKASNLASGIPA RFSGSGSGTDFTLTISSLEPEDFAVYYCQQ SWNDPLTFGQGTKLEIK |
| 737 | hBEW-9E3-B9VL.1a | ETVLTQSPATLSLSPGERATLSCRASEGVN SYMHWYQQKPGQPRLLIYKASNLASGVPA RFSGSGSGTDFTLTISSLEPEDFAVYFCQQ SWNDPLTFGQGTKLEIK |
| 738 | hBEW-9E3-B9VL.1b | ETVLTQSPATLSLSPGERATLSCRASEGVN SYMHWYQQKPGQAPRLLIYKASNLASGIPA RFSGSGSGTDFTLTISSLEPEDFAVYYCQQ SWNDPLTFGQGTKLEIK |
| 739 | hBEW-9E3-B9VL.2 | DIQMTQSPSSLSASVGDRVTITCRASEGVN SYMHWYQQKPGKAPKLLIYKASNLASGVPS RFSGSGSGTDFTLTISSLQPEDFATYYCQQ SWNDPLTFGQGTKLEIK |
| 740 | hBEW-9E3-B9VL.2a | DTQLTQSPSSLSASVGDRVTITCRASEGVN SYMHWYQQKPGKQPKLLIYKASNLASGVPS RFSGSGSGTDFTLTISSLQPEDFATYFCQQ SWNDPLTFGQGTKLEIK |
| 741 | hBEW-9E3-B9VL.2b | DTQMTQSPSSLSASVGDRVTITCRASEGVN SYMHWYQQKPGKAPKLLIYKASNLASGVPS RFSGSGSGTDFTLTISSLQPEDFATYYCQQ SWNDPLTFGQGTKLEIK | hBEW-9E3-B9VH.1z is a CDR-grafted, humanized BEW-9E3-B9 VH containing IGHV7-81*01 and IGHJ4*01 framework sequences.

hBEW-9E3-B9VH.1 is based on .1z with a Q1E change to prevent pyroglutamate formation.

hBEW-9E3-B9VH.1a is a humanized design based on .1 and contains four proposed framework back-mutations (V2I, W47Y, M71L and Y91F).

hBEW-9E3-B9VH.1b is an intermediate design between .1 and .1a and only has two back-mutations (W47Y and M71L).

hBEW-9E3-B9VH.1c is based on .1b with additional one CDR germlining change T28S to improve identity to human germline sequence.

hBEW-9E3-B9VH.2z is a CDR-grafted, humanized BEW-9E3-B9 VH containing IGHV1-18*01 and IGHJ4*01 framework sequences.

hBEW-9E3-B9VH.2 is based on .2z with a Q1E change to prevent pyroglutamate formation.

hBEW-9E3-B9VH.2a is a humanized design based on .2 and contains six proposed framework back-mutations (V2I, W47Y, V67F, M69F, T71L and Y91F).

hBEW-9E3-B9VH.2b is an intermediate design between .2 and .2a and only has two back-mutations W47Y and T71L.

hBEW-9E3-B9VL.1 is a CDR-grafted humanized BEW-9E3-B9 VL containing IGKV3-11*01 and IGKJ2*01 framework sequences.

hBEW-9E3-B9VL.1a is a humanized design based on .1 with four proposed framework back-mutations (I2T, A43Q, I58V and Y87F).

hBEW-9E3-B9VL.1b is an intermediate design between .1 and .1a with 1 proposed framework back-mutation 12T.

hBEW-9E3-B9VL.2 is a CDR-grafted humanized BEW-9E3-B9 VL containing IGKV1-39*01 and IGKJ2*01 framework sequences.

hBEW-9E3-B9VL.2a is a humanized design based on .1 with four proposed framework back-mutations (I2T, M4L, A43Q and Y87F).

hBEW-9E3-B9VL.2b is an intermediate design between .1 and .1a with 1 proposed framework back-mutation I2T.

Example 6.2.4.6: BEW-5C3

TABLE 2.4.6

Sequences of Humanized BEW-5C3 Variable Regions

| SEQ ID NO: | Protein region | Sequence 123456789012345678901234567890 |
|---|---|---|
| 742 | hBEW-5c3VH.1z | QVQLVQSGSELKKPGASVKVSCKASGYTFT NYGVYWVRQAPGQGLEWMGWINTETGKPTY ADDFKGRFVFSLDTSVSTAYLQISSLKAED TAVYYCARARQLDWFVYWGQGTLVTVSS |
| 743 | hBEW-5C3VH.1 | EVQLVQSGSELKKPGASVKVSCKASGYTFT NYGVYWVRQAPGQGLEWMGWINTETGKPTY ADDFKGRFVFSLDTSVSTAYLQISSLKAED TAVYYCARARQLDWFVYWGQGTLVTVSS |
| 744 | hBEW-5C3VH.1a | EIQLVQSGSELKKPGASVKVSCKASGYTFT NYGVYWVKQAPGQGLEYMGWINTETGKPTY ADDFKGRFVFSLDTSVSTAYLQISSLKAED TAVYYCARARQLDWFVYWGQGTLVTVSS |
| 745 | hBEW-5C3VH.1b | EIQLVQSGSELKKPGASVKVSCKASGYTFT NYGVYWVKQAPGQGLEYMGWINTETGKPTY ADDFKGRFVFSLDTSVSTAYLQISSLKAED TAVFFCARARQLDWFVYWGQGTLVTVSS |
| 746 | hBEW-5C3VH.2z | QVQLVQSGAEVKKPGSSVKVSCKASGYTFT NYGVYWVRQAPGQGLEWMGWINTETGKPTY ADDFKGRVTITADKSTSTAYMELSSLRSED TAVYYCARARQLDWFVYWGQGTLVTVSS |
| 747 | hBEW-5C3VH.2 | EVQLVQSGAEVKKPGSSVKVSCKASGYTFT NYGVYWVRQAPGQGLEWMGWINTETGKPTY ADDFKGRVTITADKSTSTAYMELSSLRSED TAVYYCARARQLDWFVYWGQGTLVTVSS |
| 748 | hBEW-5C3VH.2a | EIQLVQSGAEVKKPGSSVKVSCKASGYTFT NYGVYWVKQAPGQGLEYMGWINTETGKPTY ADDFKGRFTFLDKSTSTAYMELSSLRSED TAVYFCARARQLDWFVYWGQGTLVTVSS |
| 749 | hBEW-5C3VH.2b | EVQLVQSGAEVKKPGSSVKVSCKASGYTFT NYGVYWVRQAPGQGLEWMGWINTETGKPTY ADDFKGRFTFLDKSTSTAYMELSSLRSED TAVYYCARARQLDWFVYWGQGTLVTVSS |
| 750 | hBEW-5C3VH.2C | EIQLVQSGAEVKKPGSSVKVSCKASGYTFT NYGVYWVKQAPGQGLEYMGWINTETGKPTY ADDFKGRFVFTLDKSTSTAYLELSSLRSED TAVFFCARARQLDWFVYWGQGTLVTVSS |
| 751 | hBEW-5C3VL.1 | EIVLTQSPATLSLSPGERATLSCRARESLT TSLCWYQQKPGQAPRLLIYGASKLESGIPA RFSGSGSGTDFTLTISSLEPEDFAVYYCQQ SWYDPPTFGGGTKVEIK |
| 752 | hBEW-5C3VL.1a | DTVLTQSPATLSLSPGERATLSCRARESLT TSLSWFQQKPGQQPRLLIYGASKLESGVPA RFSGSGSGTDFTLTISSLEPEDFAVYFCQQ SWYDPPTFGGGTKVEIK |

TABLE 2.4.6-continued

Sequences of Humanized BEW-5C3 Variable Regions

| SEQ ID NO: | Protein region | Sequence 123456789012345678901234567890 |
|---|---|---|
| 753 | hBEW-5C3VL.1b | DTVLTQSPATLSLSPGERATLSCRARESLT TSLSWFQQKPGQAPRLLIYGASKLESGIPA RFSGSGSGTDFTLTISSLEPEDFAVYFCQQ SWYDPPTFGGGTKVEIK |
| 754 | hBEW-5C3VL.1c | DTVLTQSPATLSLSPGERATLSCRARESLT TSLSWYQQKPGQAPRLLIYgasklesGIPA RFSGSGSGTDFTLTISSLEPEDFAVYYCQQ SWYDPPTFGGGTKVEIK |
| 755 | hBEW-5C3VL.2 | AIQLTQSPSSLSASVGDRVTITCRARESLT TSLSWYQQKPGKAPKLLIYGASKLESGVPS RFSGSGSGTDFTLTISSLQPEDFATYYCQQ SWYDPPTFGGGTKVEIK |
| 756 | hBEW-5C3VL.2a | DTQLTQSPSSLSASVGDRVTISCRARESLT TSLSWFQQKPGKQPKLLIYGASKLESGVPS RFSGSGSGTDFTLTISSLQPEDFATYFCQQ SWYDPPTFGGGTKVEIK |
| 757 | hBEW-5C3VL.2b | DTQLTQSPSSLSASVGDRVTITCRARESLT TSLSWFQQKPGKAPKLLIYGASKLESGVPS RFSGSGSGTDFTLTISSLQPEDFATYFCQQ SWYDPPTFGGGTKVEIK |
| 758 | hBEW-5C3VL.2c | DTQLTQSPSSLSASVGDRVTITCRARESLT TSLSWYQQKPGKAPKLLIYGASKLESGVPS RFSGSGSGTDFTLTISSLQPEDFATYYCQQ SWYDPPTFGGGTKVEIK | hBEW-5C3VH.1z is a CDR-grafted, humanized BEW-5C3 VH containing IGHV7-4-1*01 and IGHJ1*01 framework sequences.

hBEW-5C3VH.1 is based on .1z with a Q1E change to prevent pyroglutamate formation.

hBEW-5C3VH.1a is a humanized design based on .1 and contains three proposed framework back-mutations (V2I, R38K, W47Y).

hBEW-5C3VH.1b is a humanized design based on .1 and contains five proposed framework back-mutations (V2I, R38K, W47Y, Y90F, Y91F).

hBEW-5C3VH.2z is a CDR-grafted, humanized BEW-5C3 VH containing IGHV1-69*06 and IGHJ1*01 framework sequences.

hBEW-5C3VH.2 is based on .2z with a Q1E change to prevent pyroglutamate formation.

hBEW-5C3VH.2a is a humanized design based on .2 and contains seven proposed framework back-mutations (V2I, R38K, W47Y, V67F, I69F, A71L, Y91F).

hBEW-5C3VH.2b is an intermediate design between .2 and .2a and contains three proposed framework back-mutations (V67F, I69F, A71L).

hBEW-5C3VH.2c is a humanized design based on .2 and contains ten proposed framework back-mutations (V2I, R38K, W47Y, V67F, T68V, I69F, A71L, M80L, Y90F, Y91F).

hBEW-5C3VL.1 is a CDR-grafted, humanized BEW-5C3 VL containing IGKV3-11*01 and IGKJ4*01 framework sequences.

hBEW-5C3VL.1a is a humanized design based on .1 and contains six proposed framework back-mutations (E1D, I2T, Y36F, A43Q, I58V, Y87F).

hBEW-5C3VL.1b is an intermediate design between .1 and .1a. It contains four proposed framework back-mutations (E1D, I2T, Y36F, Y87F).

hBEW-5C3VL.1c is a design based on .1b and contains two proposed framework back-mutations (E1D, I2T)

hBEW-5C3VL.2 is a CDR-grafted, humanized BEW-5C3 VL containing IGKV1-13*01 and IGKJ4*01 framework sequences.

hBEW-5C3VL.2a is a humanized design based on .2 and contains six proposed framework back-mutations (A1D, I2T, T22S, Y36F, A43Q, Y87F).

hBEW-5C3VL.2b is an intermediate design between .2 and 2a. It contains four proposed framework back-mutations (A1D, I2T, Y36F, Y87F).

hBEW-5C3VL.2c is a design based on .2b and contains two proposed framework back-mutations (A1D, I2T)

Example 6.2.4.7: BEW-9E10

TABLE 2.4.7

Sequences of Humanized BEW-9E10 Variable Regions

| SEQ ID NO: | Protein region | Sequence 123456789012345678901234567890 |
|---|---|---|
| 759 | hBEW-9E10VH.1z | QVQLVQSGSELKKPGASVKVSCKASGYTFT NYGMYWVRQAPGQGLEWMGWIDTETGRPTY ADDFKGRFVFSLDTSVSTAYLQISSLKAED TAVYYCARWSGDTTGIRGPWFAYWGQGTLV TVSS |
| 760 | hBEW-9E10VH.1 | EVQLVQSGSELKKPGASVKVSCKASGYTFT NYGMYWVRQAPGQGLEWMGWIDTETGRPTY ADDFKGRFVFSLDTSVSTAYLQISSLKAED TAVYYCARWSGDTTGIRGPWFAYWGQGTLV TVSS |
| 761 | hBEW-9E10VH.1a | EIQLVQSGSELKKPGASVKVSCKASGYTFT NYGMYWVKQAPGQGLEYMGWIDTETGRPTY ADDFKGRFVFSLDTSVSTAYLQISSLKAED TAVYFCARWSGDTTGIRGPWFAYWGQGTLV TVSS |
| 762 | hBEW-9E10VH.2z | QVQLVQSGAEVKKPGSSVKVSCKASGYTFT NYGMYWVRQAPGQGLEWMGWIDTETGRPTY ADDFKGRVTITADKSTSTAYMELSSLRSED TAVYYCARWSGDTTGIRGPWFAYWGQGTLV TVSS |
| 763 | hBEW-9E10VH.2 | EVQLVQSGAEVKKPGSSVKVSCKASGYTFT NYGMYWVRQAPGQGLEWMGWIDTETGRPTY ADDFKGRVTITADKSTSTAYMELSSLRSED TAVYYCARWSGDTTGIRGPWFAYWGQGTLV TVSS |
| 764 | hBEW-9E10VH.2a | EIQLVQSGAEVKKPGSSVKVSCKASGYTFT NYGMYWVKQAPGQGLEYMGWIDTETGRPTY ADDFKGRFTFTADKSTSTAYMELSSLRSED TAVYFCARWSGDTTGIRGPWFAYWGQGTLV TVSS |
| 765 | hBEW-9E10VH.2b | EVQLVQSGAEVKKPGSSVKVSCKASGYTFT NYGMYWVRQAPGQGLEWMGWIDTETGRPTY ADDFKGRFTFTADKSTSTAYMELSSLRSED TAVYYCARWSGDTTGIRGPWFAYWGQGTLV TVSS |
| 766 | hBEW-9E10VL.1 | DIQMTQSPSSLSASVGDRVTITCLASEDIY SDLAWYQQKPGKVPKLLIYNANGLQNGVPS RFSGSGSGTDFTLTISSLQPEDVATYYCQQ YNYFPGTFGQGTKLEIK |
| 767 | hBEW-9E10VL.1a | DIRMTQSPSSLSASVGDRVTIECLASEDIY SDLAWYQQKPGKSPKLLIYNANGLQNGVPS RFSGSGSGTDYSLTISSLQPEDVATYFCQQ YNYFPGTFGQGTKLEIK |

TABLE 2.4.7-continued

Sequences of Humanized BEW-9E10 Variable Regions

| SEQ ID NO: | Protein region | Sequence 123456789012345678901234567890 |
|---|---|---|
| 768 | hBEW-9E10VL.1b | DIRMTQSPSSLSASVGDRVTITCLASEDIY SDLAWYQQKPGKSPKLLIYNANGLQNGVPS RFSGSGSGTDYTLTISSLQPEDVATYFCQQ YNYFPGTFGQGTKLEIK | hBEW-9E10VH.1z is a CDR-grafted, humanized BEW-9E10 VH containing IGHV7-4-1*01 and IGHJ1*01 framework sequences.

hBEW-9E10VH.1 is based on .1z with a Q1E change to prevent pyroglutamate formation.

hBEW-9E10VH.1a is a humanized design based on .1 and contains four proposed framework back-mutations (V2I, R38K, W47Y, Y91F).

hBEW-9E10VH.2z is a CDR-grafted, humanized BEW-9E10 VH containing IGHV1-69*06 and IGHJ1*01 framework sequences.

hBEW-9E10VH.2 is based on .2z with a Q1E change to prevent pyroglutamate formation.

hBEW-9E10VH.2a is a humanized design based on .2 and contains six proposed framework back-mutations (V2I, R38K, W47Y, V67F, I69F, Y91F).

hBEW-9E10VH.2b is an intermediate design between .2 and .2a and contains two proposed framework back-mutations: (V67F, I69F).

hBEW-9E10VL.1 is a CDR-grafted, humanized BEW-9E10 VL containing IGKV1-27*01 and IGKJ2*01 framework sequences.

hBEW-9E10VL.1a is a humanized design based on .1 and contains six proposed framework back-mutations (Q3R, T22E, V43S, F71Y, T72S, Y87F).

hBEW-9E10VL.1b is an intermediate design between .1 and .1a. It contains four proposed framework back-mutations (Q3R, V43S, F71Y, Y87F).

Example 6.2.4.8: BEW-1B10

TABLE 2.4.8

Sequences of Humanized BEW-1B10 Variable Regions

| SEQ ID NO: | Protein region | Sequence 123456789012345678901234567890 |
|---|---|---|
| 769 | hBEW-1B10VH.1 | EVQLVESGGGLVQPGGSLRLSCAASGFSFS KYDMAWVRQAPGKGLEWVASITTSGVGTYY RDSVKGRFTISRDNAKNSLYLQMNSLRAED TAVYYCARGYGAMDAWGQGTTVTVSS |
| 770 | hBEW-1B10VH.1a | EVQLVESGGGLVQPGGSLRLSCAASGFSFS KYDMAWFRQAPGKGLEWVASITTSGVGTYY RDSVKGRFTVSRDNAKSTLYLQMNSLRAED TAVYYCARGYGAMDAWGQGTTVTVSS |
| 771 | hBEW-1B10VH.1b | EVQLVESGGGLVQPGGSLRLSCAASGFSFS KYDMAWFRQAPGKGLEWVASITTSGVGTYY RDSVKGRFTVSRDNAKNSLYLQMNSLRAED TAVYYCARGYGAMDAWGQGTTVTVSS |
| 772 | hBEW-1B10VL.1 | DIQMTQSPSSLSASVGDRVTITCKASQDID DYLSWYQQKPGKAPKLLIYAATRLADGVPS RFSGSGSGTDFTLTISSLQPEDFATYYCLQ SSSTPWTFGGGTKVEIK |

TABLE 2.4.8-continued

Sequences of Humanized BEW-1B10 Variable Regions

| SEQ ID NO: | Protein region | Sequence 123456789012345678901234567890 |
|---|---|---|
| 773 | hBEW-1B10VL.1a | DIQMTQSPSSLSASVGDRVTITCKASQDID DYLSWYQQKPGKSPKLVIYAATRLADGVPS RFSGSGSGTDYTLTISSLQPEDFATYYCLQ SSSTPWTFGGGTKVEIK |
| 774 | hBEW-1B10VL.1b | DIQMTQSPSSLSASVGDRVTITCKASQDID DYLSWYQQKPGKSPKLLIYAATRLADGVPS RFSGSGSGTDYTLTISSLQPEDFATYYCLQ SSSTPWTFGGGTKVEIK | hBEW-1B10VH.1 is a CDR-grafted, humanized BEW-1B10 VH containing IGHV3-7*01 and IGHJ6*01 framework sequences.

hBEW-1B10VH.1a is a humanized design based on .1 and contains four proposed framework back-mutations (V37F, I69V, N76S, S77T).

hBEW-1B10VH.1b is an intermediate design between .1 and .1a and contains two proposed framework back-mutations: (V37F, I69V).

hBEW-9E10VH.1z is a CDR-grafted, humanized BEW-9E10 VH containing IGHV7-4-1*01 and IGHJ1*01 framework sequences.

hBEW-9E10VH.1 is based on .1z with a Q1E change to prevent pyroglutamate formation.

hBEW-1B10VL.1 is a CDR-grafted, humanized BEW-1B10 VL containing IGKV1-39*01 and IGKJ4*01 framework sequences.

hBEW-1B10VL.1a is a humanized design based on .1 and contains three proposed framework back-mutations: (A43S, L47V, F71Y).

hBEW-1B10VL.1b is an intermediate design between .1 and .1a. It contains two proposed framework back-mutations (A43S, F71Y).

Example 6.2.4.9: BEW-1E3

TABLE 2.4.9

Sequences of Humanized BEW-1E3 Variable Regions

| SEQ ID NO: | Protein region | Sequence 123456789012345678901234567890 |
|---|---|---|
| 775 | hBEW-1E3VH.1z | QVQLVQSGSELKKPGASVKVSCKASGYPFT NSGMYWVRQAPGQGLEWMGWINTEAGKPTY ADDFKGRFVFSLDTSVSTAYLQISSLKAED TAVYYCARWGYISDNSYGWFDYWGQGTLVT VSS |
| 776 | hBEW-1E3VH.1 | EVQLVQSGSELKKPGASVKVSCKASGYPFT NSGMYWVRQAPGQGLEWMGWINTEAGKPTY ADDFKGRFVFSLDTSVSTAYLQISSLKAED TAVYYCARWGYISDNSYGWFDYWGQGTLVT VSS |
| 777 | hBEW-1E3VH.1a | EIQLVQSGSELKKPGASVKVSCKASGYPFT NSGMYWVKQAPGQGLEYMGWINTEAGKPTY ADDFKGRFVFSLDTSVSTAYLQISSLKAED TAVYFCARWGYISDNSYGWFDYWGQGTLVT VSS |

TABLE 2.4.9-continued

Sequences of Humanized BEW-1E3 Variable Regions

| SEQ ID NO: | Protein region | Sequence 123456789012345678901234567890 |
|---|---|---|
| 778 | hBEW-1E3VH.2z | QVQLVQSGAEVKKPGASVKVSCKASGYPFT NSGMYWVRQAPGQGLEWMGWINTEAGKPTY ADDFKGRVTMTTDTSTSTAYMELRSLRSDD TAVYYCARWGYISDNSYGWFDYWGQGTLVT VSS |
| 779 | hBEW-1E3VH.2 | EVQLVQSGAEVKKPGASVKVSCKASGYPFT NSGMYWVRQAPGQGLEWMGWINTEAGKPTY ADDFKGRVTMTTDTSTSTAYMELRSLRSDD TAVYYCARWGYISDNSYGWFDYWGQGTLVT VSS |
| 780 | hBEW-1E3VH.2a | EIQLVQSGAEVKKPGASVKVSCKASGYPFT NSGMYWVKQAPGQGLEYMGWINTEAGKPTY ADDFKGRFTFTLDTSTSTAYLEIRSLRSDD TAVYFCARWGYISDNSYGWFDYWGQGTLVT VSS |
| 781 | hBEW-1E3VH.2b | EVQLVQSGAEVKKPGASVKVSCKASGYPFT NSGMYWVRQAPGQGLEWMGWINTEAGKPTY ADDFKGRFTFTLDTSTSTAYLEIRSLRSDD TAVYYCARWGYISDNSYGWFDYWGQGTLVT VSS |
| 782 | hBEW-1E3VL.1 | EIVLTQSPATLSLSPGERATLSCRASEGVY SYMHWYQQKPGQAPRLLIYKASNLASGIPA RFSGSGSGTDFTLTISSLEPEDFAVYYCHQ NWNDPLTFGQGTKLEIK |
| 783 | hBEW-1E3VL.1a | ETVLTQSPATLSLSPGERATLSCRASEGVY SYMHWYQQKPGQQPRLLIYKASNLASGVPA RFSGSGSGTDFTLTISSLEPEDFAVYFCHQ NWNDPLTFGQGTKLEIK |
| 784 | hBEW-1E3VL.1b | EIVLTQSPATLSLSPGERATLSCRASEGVY SYMHWYQQKPGQAPRLLIYKASNLASGVPA RFSGSGSGTDFTLTISSLEPEDFAVYFCHQ NWNDPLTFGQGTKLEIK |
| 785 | hBEW-1E3VL.2 | AIQLTQSPSSLSASVGDRVTITCRASEGVY SYMHWYQQKPGKAPKLLIYKASNLASGVPS RFSGSGSGTDFTLTISSLQPEDFATYYCHQ NWNDPLTFGQGTKLEIK |
| 786 | hBEW-1E3VL.2a | ATQLTQSPSSLSASVGDRVTISCRASEGVY SYMHWYQQKPGKQPKLLIYKASNLASGVPS RFSGSGSGTDFTLTISSLQPEDFATYFCHQ NWNDPLTFGQGTKLEIK |
| 787 | hBEW-1E3VL.2b | AIQLTQSPSSLSASVGDRVTITCRASEGVY SYMHWYQQKPGKAPKLLIYKASNLASGVPS RFSGSGSGTDFTLTISSLQPEDFATYFCHQ NWNDPLTFGQGTKLEIK | hBEW-1E3VH.1z is a CDR-grafted, humanized BEW-1E3 VH containing IGHV7-4-1*01 and IGHJ1*01 framework sequences.

hBEW-1E3VH.1 is based on .1z with a Q1E change to prevent pyroglutamate formation.

hBEW-1E3VH.1a is a humanized design based on .1 and contains four proposed framework back-mutations (V2I, R38K, W47Y, Y91F).

hBEW-1E3VH.2z is a CDR-grafted, humanized BEW-1E3 VH containing IGHV1-18*01 and IGHJ1*01 framework sequences.

hBEW-1E3VH.2 is based on .2z with a Q1E change to prevent pyroglutamate formation.

hBEW-1E3VH.2a is a humanized design based on .2 and contains seven proposed framework back-mutations (V2I, R38K, W47Y, V67F, M69F, T71L, Y91F).

hBEW-1E3VH.2b is an intermediate design between .2 and .2a and contains three proposed framework back-mutations (V67F, M69F, T71L).

hBEW-1E3VL.1 is a CDR-grafted, humanized BEW-1E3 VL containing IGKV3-11*01 and IGKJ2*01 framework sequences.

hBEW-1E3VL.1a is a humanized design based on .1 and contains four proposed framework back-mutations (I2T, A43Q, I58V, Y87F).

hBEW-1E3VL.1b is an intermediate design between .1 and .1a. It contains two proposed framework back-mutations (I58V, Y87F).

hBEW-1E3VL.2 is a CDR-grafted, humanized BEW-1E3 VL containing IGKV1-13*01 and IGKJ2*01 framework sequences.

hBEW-1E3VL.2a is a humanized design based on .2 and contains four proposed framework back-mutations (I2T, T22S, A43Q, Y87F).

hBEW-1E3VL.2b is an intermediate design between .2 and 2a. It contains one proposed framework back-mutations Y87F.

Example 6.3: Humanization of VEGFRII Antibodies

Example 6.3.1: Humanization Method

Antibody humanization is achieved by grafting CDRs of the rodent antibody onto a "similar" human framework (acceptor) and incorporating minimal number of key framework residues (back-mutation) from the rodent antibody that are selected to maintain the original CDR conformation in order to minimize the immunogenicity while retaining the optimal antigen binding.

Example 6.3.2: Human Germline Sequence Selections for Constructing CDR-Grafted, Humanized VEGFRII Antibodies By applying the aforementioned method, the CDR sequences of VH and VL chains of monoclonal antibody BCU-6B1-G6 were grafted onto different human heavy and light chain acceptor sequences.

Example 6.3.2.1: BCU-6B1-G6

Based on the alignments with the VH and VL sequences of monoclonal antibody BCU-6B1-G6 of the present invention, the following known human sequences are selected:
1. IGHV7-4-1*01 and IGHJ1*01 for constructing heavy chain acceptor sequences
2. IGHV1-18*01 and IGHJ1*01 as alternative acceptor for constructing heavy chain
3. IGKV1-27*01 and IGKJ4*01 for constructing light chain acceptor sequences By grafting the corresponding VH and VL CDRs of BCU-6B1-G6 into said acceptor sequences, the CDR-grafted, humanized, and modified VH and VL sequences were prepared.

Example 6.3.3: Introducing Potential Framework Back-Mutations in CDR-Grafted Antibodies To generate humanized antibody with potential framework back-mutations, the mutations were identified and introduced into the CDR-grafted antibody sequences by de novo synthesis of the variable domain, or mutagenic oligonucleotide primers and polymerase chain reactions, or by methods well known in the art. Different combinations of back mutations and other mutations are constructed for each of the CDR-grafts as follows. Residue numbers for these mutations are based on the Kabat numbering system.

Example 6.3.3.1: BCU-6B1-G6

When IGHV7-4-1*01 and IGHJ1*01 selected as BCU-6B1-G6 heavy chain acceptor sequence, one or more of the following residues could back-mutated as follows: W47→F. Additional mutations include the following: R38→K, Y91→F.

When IGHV1-18*01 and IGHJ1*01 selected as BCU-6B1-G6 heavy chain acceptor sequence, one or more of the following residues could back-mutated as follows: W47→F, V67→F, M69→F, T71→L. Additional mutations include the following: R38→K, Y91→F.

When IGKV1-27*01 and IGKJ4*01 selected as BCU-6B1-G6 light chain acceptor sequence, one or more of the following residues could back-mutated as follows: V43→S, Y49→F, F71→Y, Y87→F. Additional mutations include the following: T22→E, T72→S.

Example 6.3.4: Generation of Humanized Antibodies to VEGFRII Containing Framework Back-Mutations in CDR-Grafted Antibodies The following humanized variable regions of the murine monoclonal VEGFRII antibodies were cloned into IgG expression vectors for functional characterization.

Example 6.3.4.1: BCU-6B1-G6

TABLE 3.4.1

Sequences of Humanized BCU-6B1-G6 Variable Regions

| SEQ ID NO: | Protein region | Sequence<br>12345678901234567890123456789 0 |
|---|---|---|
| 788 | hBCU-6B1-G6VH.1z | QVQLVQSGSELKKPGASVKVSCKASGYTFT<br>NYGMYWVRQAPGQGLEWMGWINTETGQPTY<br>ADDFKGRFVFSLDTSVSTAYLQISSLKAED<br>TAVYYCARLGNNYGIWFAYWGQGTLVTVSS |
| 789 | hBCU-6B1-G6VH.1 | EVQLVQSGSELKKPGASVKVSCKASGYTFT<br>NYGMYWVRQAPGQGLEWMGWINTETGQPTY<br>ADDFKGRFVFSLDTSVSTAYLQISSLKAED<br>TAVYYCARLGNNYGIWFAYWGQGTLVTVSS |
| 790 | hBCU-6B1-G6VH.1a | EVQLVQSGSELKKPGASVKVSCKASGYTFT<br>NYGMYWVKQAPGQGLEFMGWINTETGQPTY<br>ADDFKGRFVFSLDTSVSTAYLQISSLKAED<br>TAVYFCARLGNNYGIWFAYWGQGTLVTVSS |
| 791 | hBCU-6B1-G6VH.1b | EVQLVQSGSELKKPGASVKVSCKASGYTFT<br>NYGMYWVRQAPGQGLEFMGWINTETGQPTY<br>ADDFKGRFVFSLDTSVSTAYLQISSLKAED<br>TAVYYCARLGNNYGIWFAYWGQGTLVTVSS |
| 792 | hBCU-6B1-G6VH.2z | QVQLVQSGAEVKKPGASVKVSCKASGYTFT<br>NYGMYWVRQAPGQGLEWMGWINTETGQPTY<br>ADDFKGRVTMTTDTSTSTAYMELRSLRSDD<br>TAVYYCARLGNNYGIWFAYWGQGTLVTVSS |
| 793 | hBCU-6B1-G6VH.2 | EVQLVQSGAEVKKPGASVKVSCKASGYTFT<br>NYGMYWVRQAPGQGLEWMGWINTETGQPTY<br>ADDFKGRVTMTTDTSTSTAYMELRSLRSDD<br>TAVYYCARLGNNYGIWFAYWGQGTLVTVSS |

TABLE 3.4.1-continued

Sequences of Humanized BCU-6B1-G6 Variable Regions

| SEQ ID NO | Protein region | Sequence 123456789012345678901234567890 |
|---|---|---|
| 794 | hBCU-6B1-G6VH.2a | EVQLVQSGAEVKKPGASVKVSCKASGYTFT NYGMYWVKQAPGQGLEFMGWINTETGQPTY ADDFKGRFTFTLDTSTSTAYMELRSLRSDD TAVYFCARLGNNYGIWFAYWGQGTLVTVSS |
| 795 | hBCU-6B1-G6VH.2b | EVQLVQSGAEVKKPGASVKVSCKASGYTFT NYGMYWVRQAPGQGLEFMGWINTETGQPTY ADDFKGRFTFTLDTSTSTAYMELRSLRSDD TAVYYCARLGNNYGIWFAYWGQGTLVTVSS |
| 796 | hBCU-6B1-G6VL.1 | DIQMTQSPSSLSASVGDRVTITCRASDDLY STLAWYQQKPGKVPKLLIYDANRLAAGVPS RFSGSGSGTDFTLTISSLQPEDVATYYCQQ YNKFPWTFGGGTKVEIK |
| 797 | hBCU-6B1-G6VL.1a | DIQMTQSPSSLSASVGDRVTIECRASDDLY STLAWYQQKPGKSPKLLIFDANRLAAGVPS RFSGSGSGTDYSLTISSLQPEDVATYFCQQ YNKFPWTFGGGTKVEIK |
| 798 | hBCU-6B1-G6VL.1b | DIQMTQSPSSLSASVGDRVTITCRASDDLY STLAWYQQKPGKSPKLLIFDANRLAAGVPS RFSGSGSGTDYTLTISSLQPEDVATYFCQQ YNKFPWTFGGGTKVEIK | hBCU-6B1-G6VH.1z is a CDR-grafted, humanized BCU-6B1-G6 VH containing IGHV7-4-1*01 and IGHJ1*01 framework sequences.

hBCU-6B1-G6VH.1 is based on .1z with a Q1E change to prevent pyroglutamate formation.

hBCU-6B1-G6VH.1a is a humanized design based on .1 and contains 3 proposed framework back-mutations: (R38K, W47F, Y91F).

hBCU-6B1-G6VH.1b is an intermediate design between .1 and .1a and contains 1 proposed framework back-mutations: W47F hBCU-6B1-G6VH.2z is a CDR-grafted, humanized BCU-6B1-G6 VH containing IGHV1-18*01 and IGHJ1*01 framework sequences.

hBCU-6B1-G6VH.2 is based on .2z with a Q1E change to prevent pyroglutamate formation.

hBCU-6B1-G6VH.2a is a humanized design based on .2 and contains six proposed framework back-mutations (R38K, W47F, V67F, M69F, T71L, Y91F).

hBCU-6B1-G6VH.2b is an intermediate design between .2 and .2a and contains four proposed framework back-mutations: W47F, V67F, M69F, T71L.

hBCU-6B1-G6VL.1 is a CDR-grafted, humanized BCU-6B1-G6 VL containing IGKV1-27*01 and IGKJ4*01 framework sequences.

hBCU-6B1-G6VL.1a is a humanized design based on .1 and contains six proposed framework back-mutations (T22E, V43S, Y49F, F71Y, T72S, Y87F).

hBCU-6B1-G6VL.1b is an intermediate design between .1 and .1a. It contains four proposed framework back-mutations (V43S, Y49F, F71Y, Y87F).

Example 6.4: Humanization of PDGFRB Antibodies

Example 6.4.1: Humanization Method

Antibody humanization is achieved by grafting CDRs of the rodent antibody onto a "similar" human framework (acceptor) and incorporating minimal number of key framework residues (back-mutation) from the rodent antibody that are selected to maintain the original CDR conformation in order to minimize the immunogenicity while retaining the optimal antigen binding.

Example 6.4.2: Human Germline Sequence Selections for Constructing CDR-Grafted, Humanized PDGFRB Antibodies By applying the aforementioned method, the CDR sequences of VH and VL chains of monoclonal antibody BDE-3C9-G4 was grafted onto different human heavy and light chain acceptor sequences.

Example 6.4.2.1: BDE-3C9-G4

Based on the alignments with the VH and VL sequences of monoclonal antibody BDE-3C9-G4 of the present invention, the following known human sequences are selected:

1. IGHV3-7*01 and IGHJ3*01 for constructing heavy chain acceptor sequences
2. IGKV1-33*01 and IGKJ4*01 for constructing light chain acceptor sequences By grafting the corresponding VH and VL CDRs of BDE-3C9-G4 into said acceptor sequences, the CDR-grafted, humanized, and modified VH and VL sequences were prepared.

Example 6.4.3: Introducing Potential Framework Back-Mutations in CDR-Grafted Antibodies To generate humanized antibody with potential framework back-mutations, the mutations were identified and introduced into the CDR-grafted antibody sequences by de novo synthesis of the variable domain, or mutagenic oligonucleotide primers and polymerase chain reactions, or by methods well known in the art. Different combinations of back mutations and other mutations are constructed for each of the CDR-grafts as follows. Residue numbers for these mutations are based on the Kabat numbering system.

Example 6.4.3.1: BDE-3C9-G4

When IGHV3-7*01 and IGHJ3*01 selected as BDE-3C9-G4 heavy chain acceptor sequence, one or more of the following residues could back-mutated as follows: S77→T, L78→Q, Y91→F.

When IGKV1-33*01 and IGKJ4*01 selected as BDE-3C9-G4 light chain acceptor sequence, one or more of the following residues could back-mutated as follows: Q38→L, K45→R, I48→M, Y49→R, T69→R, F71→Y. Additional mutations include the following: V584T.

Example 6.4.4: Generation of Humanized Antibodies to PDGFRB Containing Framework Back-Mutations in CDR-Grafted Antibodies The following humanized variable regions of the murine monoclonal PDGFRB antibodies were cloned into IgG expression vectors for functional characterization.

Example 6.4.4.1: BDE-3C9-G4

TABLE 4.4.1

Sequences of Humanized BDE-3C9-G4 Variable Regions

| SEQ ID NO: | Protein region | Sequence 123456789012345678901234567890 |
|---|---|---|
| 799 | hBDE-3C9-G4VH.1 | EVQLVESGGGLVQPGGSLRLSCAASGFTFS NYGMAWVRQAPGKGLEWVASITNSGGNTYY RDSVKGRFTISRDNAKNSLYLQMNSLRAED TAVYYCARHTPGANYFDYWGQGTMVTVSS |
| 800 | hBDE-3C9-G4VH.1a | EVQLVESGGGLVQPGGSLRLSCAASGFTFS NYGMAWVRQAPGKGLEWVASITNSGGNTYY RDSVKGRFTISRDNAKNTQYLQMNSLRAED TAVYFCARHTPGANYFDYWGQGTMVTVSS |
| 801 | hBDE-3C9-G4VL.1 | DIQMTQSPSSLSASVGDRVTITCQASQSIK NYIAWYQQKPGKAPKLLIYYTSTLESGVPS RFSGSGSGTDFTFTISSLQPEDIATYYCVQ YANLYTFGGGTKVEIK |
| 802 | hBDE-3C9-G4VL.1a | DIQMTQSPSSLSASVGDRVTITCQASQSIK NYIAWYQLKPGKAPRLLMRYTSTLESGTPS RFSGSGSGRDYTFTISSLQPEDIATYYCVQ YANLYTFGGGTKVEIK |

TABLE 4.4.1-continued

Sequences of Humanized BDE-3C9-G4 Variable Regions

| SEQ ID NO: | Protein region | Sequence 123456789012345678901234567890 |
|---|---|---|
| 803 | hBDE-3C9-G4VL.1b | DIQMTQSPSSLSASVGDRVTITCQASQSIK NYIAWYQQKPGKAPRLLIRYTSTLESGVPS RFSGSGSGRDYTFTISSLQPEDIATYYCVQ YANLYTFGGGTKVEIK | hBDE-3C9-G4VH.1 is a CDR-grafted, humanized BDE-3C9-G4 VH containing IGHV3-7*01 and IGHJ3*01 framework sequences.

hBDE-3C9-G4VH.1a is a humanized design based on .1 and contains three proposed framework back-mutations (S77T, L78Q, Y91F).

hBDE-3C9-G4VL.1 is a CDR-grafted, humanized BDE-3C9-G4 VL containing IGKV1-33*01 and IGKJ4*01 framework sequences.

hBDE-3C9-G4VL.1a is a humanized design based on .1 and contains seven proposed framework back-mutations (Q38L, K45R, I48M, Y49R, V58T, T69R, F71Y).

hBDE-3C9-G4VL.1b is an intermediate design between .1 and .1a. It contains four proposed framework back-mutations (K45R, Y49R, T69R, F71Y).

Summary of VH and VL Amino Acid Sequences of Humanized Rat Anti-Human VEGF-A and Humanized Rat Anti-Human PDGF-BB Monoclonal Antibodies

TABLE 27

VH and VL Amino Acid Sequences of Humanized Rat Anti-Human VEGF-A Monoclonal Antibodies (CDRs in bold)

| SEQ ID NO: | Clone | Protein Region | V Region 123456789012345678901234567890 |
|---|---|---|---|
| 804 | hBDB-4G8.1 | VH | EVQLVQSGSELKKPGASVKVSCKASG YTFTNYGMYWVRQAPGQGLEWMGWIN TETGKPTYADDFKGRFVFSLDTSVST AYLQISSLKAEDTAVYYCARTNYYYR SYIFYFDYWGQGTMVTVSS |
| 805 | hBDB-4G8.1 | CDR-H1 | GYTFTNYGMY |
| 806 | hBDB-4G8.1 | CDR-H2 | WINTETGKPTYADDFKG |
| 807 | hBDB-4G8.1 | CDR-H3 | TNYYYRSYIFYFDY |
| 808 | hBDB-4G8.1 | VL | AIQLTQSPSSLSASVGDRVTITCRAS ESVSTHMHWYQQKPGKAPKLLIYGAS NLESGVPSRFSGSGSGTDFTLTISSL QPEDFATYYCQQSWNDPFTFGQGTKL EIK |
| 809 | hBDB-4G8.1 | CDR-L1 | RASESVSTHMH |
| 810 | hBDB-4G8.1 | CDR-L2 | GASNLES |
| 811 | hBDB-4G8.1 | CDR-L3 | QQSWNDPFT |
| 812 | hBDB-4G8.10 | VH | EIQLVQSGAEVKKPGASVKVSCKASG YTFTNYGMYWVRQAPGQGLEYMGWIN TETGKPTYADDFKGRFTFTLDTSTST AYMELRSLRSDDTAVYFCARTNYYYR SYIFYFDYWGQGTMVTVSS |
| 813 | hBDB-4G8.10 | CDR-H1 | GYTFTNYGMY |
| 814 | hBDB-4G8.10 | CDR-H2 | WINTETGKPTYADDFKG |
| 815 | hBDB-4G8.10 | CDR-H3 | TNYYYRSYIFYFDY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 816 | hBDB-4G8.10 | VL | AIQLTQSPSSLSASVGDRVTITCRAS ESVSTHMHWYQQKPGKAPKLLIYGAS NLESGVPSRFSGSGSGTDFTLTISSL QPEDFATYYCQQSWNDPFTFGQGTKL EIK |
| 817 | hBDB-4G8.10 | CDR-L1 | RASESVSTHMH |
| 818 | hBDB-4G8.10 | CDR-L2 | GASNLES |
| 819 | hBDB-4G8.10 | CDR-L3 | QQSWNDPFT |
| 820 | hBDB-4G8.11 | VH | EIQLVQSGAEVKKPGASVKVSCKASG YTFTNYGMYWVRQAPGQGLEYMGWIN TETGKPTYADDFKGRFTFTLDTSTST AYMELRSLRSDDTAVYFCARTNYYYR SYIFYFDYWGQGTMVTVSS |
| 821 | hBDB-4G8.11 | CDR-H1 | GYTFTNYGMY |
| 822 | hBDB-4G8.11 | CDR-H2 | WINTETGKPTYADDFKG |
| 823 | hBDB-4G8.11 | CDR-H3 | TNYYYRSYIFYFDY |
| 824 | hBDB-4G8.11 | VL | ATQLTQSPSLSASVGDRVTITCRASE SVSTHMHWYQQKPGKQPKLLIYGASN LESGVPSRFSGSGSGTDFTLTISSLQ PEDFATYFCQQSWNDPFTFGQGTKLE IK |
| 825 | hBDB-4G8.11 | CDR-L1 | RASESVSTHMH |
| 826 | hBDB-4G8.11 | CDR-L2 | GASNLES |
| 827 | hBDB-4G8.11 | CDR-L3 | QQSWNDPFT |
| 828 | hBDB-4G8.12 | VH | EIQLVQSGAEVKKPGASVKVSCKASG YTFTNYGMYWVRQAPGQGLEYMGWIN TETGKPTYADDFKGRFTFTLDTSTST AYMELRSLRSDDTAVYFCARTNYYYR SYIFYFDYWGQGTMVTVSS |
| 829 | hBDB-4G8.12 | CDR-H1 | GYTFTNYGMY |
| 830 | hBDB-4G8.12 | CDR-H2 | WINTETGKPTYADDFKG |
| 831 | hBDB-4G8.12 | CDR-H3 | TNYYYRSYIFYFDY |
| 832 | hBDB-4G8.12 | VL | DTVLTQSPATLSLSPGERATLSCRAS ESVSTHMHWYQQKPGQAPRLLIYGAS NLESGVPARFSGSGSGTDFTLTISSL EPEDFAVYFCQQSWNDPFTFGQGTKL EIK |
| 833 | hBDB-4G8.12 | CDR-L1 | RASESVSTHMH |
| 834 | hBDB-4G8.12 | CDR-L2 | GASNLES |
| 835 | hBDB-4G8.12 | CDR-L3 | QQSWNDPFT |
| 836 | hBDB-4G8.13 | VH | EIQLVQSGTEVKKPGESLKISCKASG YTFTNYGMYWVKQMPGKGLEYMGWIN TETGKPTYADDFKGRFTFSLDKSFNT AFLQWSSLKASDTAMYFCARTNYYYR SYIFYFDYWGQGTMVTVSS |
| 837 | hBDB-4G8.13 | CDR-H1 | GYTFTNYGMY |
| 838 | hBDB-4G8.13 | CDR-H2 | WINTETGKPTYADDFKG |
| 839 | hBDB-4G8.13 | CDR-H3 | TNYYYRSYIFYFDY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 123456789012345678901234567890 |
|---|---|---|---|
| 840 | hBDB-4G8.13 | VL | ETVLTQSPATLSVSPGERATLSCRAS ESVSTHMHWYQQKPGQAPRLLIYGAS NLESGVPARFSGSGSGTDFTLTISSL QSEDFAVYFCQQSWNDPFTFGQGTRL EIK |
| 841 | hBDB-4G8.13 | CDR-L1 | RASESVSTHMH |
| 842 | hBDB-4G8.13 | CDR-L2 | GASNLES |
| 843 | hBDB-4G8.13 | CDR-L3 | QQSWNDPFT |
| 844 | hBDB-4G8.14 | VH | EIQLVQSGGGVVQPGGSLRLSCAASG YTFTNYGMYWVKQAPGKGLEYMGWIN TETGKPTYADDFKGRFTFSLDTSKST AYLQLNSLRAEDTAVYFCARTNYYYR SYIFYFDYWGQGTLVTVSS |
| 845 | hBDB-4G8.14 | CDR-H1 | GYTFTNYGMY |
| 846 | hBDB-4G8.14 | CDR-H2 | WINTETGKPTYADDFKG |
| 847 | hBDB-4G8.14 | CDR-H3 | TNYYYRSYIFYFDY |
| 848 | hBDB-4G8.14 | VL | DTVLTQSPSTLSASPGERATISCRAS ESVSTHMHWYQQKPGQAPKLLIYGAS NLESGVPSRFSGSRSGTDFTLTISSL QPEDFAVYFCQQSWNDPFTFGQGTKV EIK |
| 849 | hBDB-4G8.14 | CDR-L1 | RASESVSTHMH |
| 850 | hBDB-4G8.14 | CDR-L2 | GASNLES |
| 851 | hBDB-4G8.14 | CDR-L3 | QQSWNDPFT |
| 852 | hBDB-4G8.15 | VH | EVQLVESGGGLVQPGGSLRLSCAASG YTFTNYGMYWVKQAPGKGLEYMGWIN TETGKPTYADDFKGRFTFSLDTSKST AYLQMNSLRAEDTAVYFCARTNYYYR SYIFYFDYWGQGTLVTVSS |
| 853 | hBDB-4G8.15 | CDR-H1 | GYTFTNYGMY |
| 854 | hBDB-4G8.15 | CDR-H2 | WINTETGKPTYADDFKG |
| 855 | hBDB-4G8.15 | CDR-H3 | TNYYYRSYIFYFDY |
| 856 | hBDB-4G8.15 | VL | DTQLTQSPSSLSASVGDRVTISCRAS ESVSTHMHWYQQKPGKAPKLLIYGAS NLESGVPSRFSGSGSGTDFTLTISSL QPEDFATYFCQQSWNDPFTFGQGTKV EIK |
| 857 | hBDB-4G8.15 | CDR-L1 | RASESVSTHMH |
| 858 | hBDB-4G8.15 | CDR-L2 | GASNLES |
| 859 | hBDB-4G8.15 | CDR-L3 | QQSWNDPFT |
| 860 | hBDB-4G8.2 | VH | EVQLVQSGSELKKPGASVKVSCKASG YTFTNYGMYWVRQAPGQGLEWMGWIN TETGKPTYADDFKGRFVFSLDTSVST AYLQISSLKAEDTAVYYCARTNYYYR SYIFYFDYWGQGTMVTVSS |
| 861 | hBDB-4G8.2 | CDR-H1 | GYTFTNYGMY |
| 862 | hBDB-4G8.2 | CDR-H2 | WINTETGKPTYADDFKG |
| 863 | hBDB-4G8.2 | CDR-H3 | TNYYYRSYIFYFDY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 123456789012345678901234567890 |
|---|---|---|---|
| 864 | hBDB-4G8.2 | VL | ATQLTQSPSLSASVGDRVTITCRASE SVSTHMHWYQQKPGKQPKLLIYGASN LESGVPSRFSGSGSGTDFTLTISSLQ PEDFATYFCQQSWNDPFTFGQGTKLE IK |
| 865 | hBDB-4G8.2 | CDR-L1 | RASESVSTHMH |
| 866 | hBDB-4G8.2 | CDR-L2 | GASNLES |
| 867 | hBDB-4G8.2 | CDR-L3 | QQSWNDPFT |
| 868 | hBDB-4G8.3 | VH | EVQLVQSGSELKKPGASVKVSCKASG YTFTNYGMYWVRQAPGQGLEWMGWIN TETGKPTYADDFKGRFVFSLDTSVST AYLQISSLKAEDTAVYYCARTNYYR SYIFYFDYWGQGTMVTVSS |
| 869 | hBDB-4G8.3 | CDR-H1 | GYTFTNYGMY |
| 870 | hBDB-4G8.3 | CDR-H2 | WINTETGKPTYADDFKG |
| 871 | hBDB-4G8.3 | CDR-H3 | TNYYYRSYIFYFDY |
| 872 | hBDB-4G8.3 | VL | DTVLTQSPATLSLSPGERATLSCRAS ESVSTHMHWYQQKPGQAPRLLIYGAS NLESGVPARFSGSGSGTDFTLTISSL EPEDFAVYFCQQSWNDPFTFGQGTKL EIK |
| 873 | hBDB-4G8.3 | CDR-L1 | RASESVSTHMH |
| 874 | hBDB-4G8.3 | CDR-L2 | GASNLES |
| 875 | hBDB-4G8.3 | CDR-L3 | QQSWNDPFT |
| 876 | hBDB-4G8.4 | VH | EIQLVQSGSELKKPGASVKVSCKASG YTFTNYGMYWVRQAPGQGLEYMGWIN TETGKPTYADDFKGRFVFSLDTSVST AYLQISSLKAEDTAVYFCARTNYYYR SYIFYFDYWGQGTMVTVSS |
| 877 | hBDB-4G8.4 | CDR-H1 | GYTFTNYGMY |
| 878 | hBDB-4G8.4 | CDR-H2 | WINTETGKPTYADDFKG |
| 879 | hBDB-4G8.4 | CDR-H3 | TNYYYRSYIFYFDY |
| 880 | hBDB-4G8.4 | VL | AIQLTQSPSSLSASVGDRVTITCRAS ESVSTHMHWYQQKPGKAPKLLIYGAS NLESGVPSRFSGSGSGTDFTLTISSL QPEDFATYYCQQSWNDPFTFGQGTKL EIK |
| 881 | hBDB-4G8.4 | CDR-L1 | RASESVSTHMH |
| 882 | hBDB-4G8.4 | CDR-L2 | GASNLES |
| 883 | hBDB-4G8.4 | CDR-L3 | QQSWNDPFT |
| 884 | hBDB-4G8.5 | VH | EIQLVQSGSELKKPGASVKVSCKASG YTFTNYGMYWVRQAPGQGLEYMGWIN TETGKPTYADDFKGRFVFSLDTSVST AYLQISSLKAEDTAVYFCARTNYYYR SYIFYFDYWGQGTMVTVSS |
| 885 | hBDB-4G8.5 | CDR-H1 | GYTFTNYGMY |
| 886 | hBDB-4G8.5 | CDR-H2 | WINTETGKPTYADDFKG |
| 887 | hBDB-4G8.5 | CDR-H3 | TNYYYRSYIFYFDY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 888 | hBDB-4G8.5 | VL | ATQLTQSPSLSASVGDRVTITCRASE SVSTHMHWYQQKPGKQPKLLIYGASN LESGVPSRFSGSGSGTDFTLTISSLQ PEDFATYFCQQSWNDPFTFGQGTKLE IK |
| 889 | hBDB-4G8.5 | CDR-L1 | RASESVSTHMH |
| 890 | hBDB-4G8.5 | CDR-L2 | GASNLES |
| 891 | hBDB-4G8.5 | CDR-L3 | QQSWNDPFT |
| 892 | hBDB-4G8.6 | VH | EIQLVQSGSELKKPGASVKVSCKASG YTFTNYGMYWVRQAPGQGLEYMGWIN TETGKPTYADDFKGRFVFSLDTSVST AYLQISSLKAEDTAVYFCARTNYYR SYIFYFDYWGQGTMVTVSS |
| 893 | hBDB-4G8.6 | CDR-H1 | GYTFTNYGMY |
| 894 | hBDB-4G8.6 | CDR-H2 | WINTETGKPTYADDFKG |
| 895 | hBDB-4G8.6 | CDR-H3 | TNYYRSYIFYFDY |
| 896 | hBDB-4G8.6 | VL | DTVLTQSPATLSLSPGERATLSCRAS ESVSTHMHWYQQKPGQAPRLLIYGAS NLESGVPARFSGSGSGTDFTLTISSL EPEDFAVYFCQQSWNDPFTFGQGTKL EIK |
| 897 | hBDB-4G8.6 | CDR-L1 | RASESVSTHMH |
| 898 | hBDB-4G8.6 | CDR-L2 | GASNLES |
| 899 | hBDB-4G8.6 | CDR-L3 | QQSWNDPFT |
| 900 | hBDB-4G8.7 | VH | EVQLVQSGAEVKKPGASVKVSCKASG YTFTNYGMYWVRQAPGQGLEWMGWIN TETGKPTYADDFKGRVTMTTDTSTST AYMELRSLRSDDTAVYYCARTNYYR SYIFYFDYWGQGTMVTVSS |
| 901 | hBDB-4G8.7 | CDR-H1 | GYTFTNYGMY |
| 902 | hBDB-4G8.7 | CDR-H2 | WINTETGKPTYADDFKG |
| 903 | hBDB-4G8.7 | CDR-H3 | TNYYRSYIFYFDY |
| 904 | hBDB-4G8.7 | VL | AIQLTQSPSSLSASVGDRVTITCRAS ESVSTHMHWYQQKPGKAPKLLIYGAS NLESGVPSRFSGSGSGTDFTLTISSL QPEDFATYYCQQSWNDPFTFGQGTKL EIK |
| 905 | hBDB-4G8.7 | CDR-L1 | RASESVSTHMH |
| 906 | hBDB-4G8.7 | CDR-L2 | GASNLES |
| 907 | hBDB-4G8.7 | CDR-L3 | QQSWNDPFT |
| 908 | hBDB-4G8.8 | VH | EVQLVQSGAEVKKPGASVKVSCKASG YTFTNYGMYWVRQAPGQGLEWMGWIN TETGKPTYADDFKGRVTMTTDTSTST AYMELRSLRSDDTAVYYCARTNYYR SYIFYFDYWGQGTMVTVSS |
| 909 | hBDB-4G8.8 | CDR-H1 | GYTFTNYGMY |
| 910 | hBDB-4G8.8 | CDR-H2 | WINTETGKPTYADDFKG |
| 911 | hBDB-4G8.8 | CDR-H3 | TNYYRSYIFYFDY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 123456789012345678901234567890 |
|---|---|---|---|
| 912 | hBDB-4G8.8 | VL | ATQLTQSPSLSASVGDRVTITCRASESVSTHMHWYQQKPGKQPKLLIYGASNLESGVPSRFSGSGSGTDFTLISSLQPEDFATYFCQQSWNDPFTFGQGTKLEIK |
| 913 | hBDB-4G8.8 | CDR-L1 | RASESVSTHMH |
| 914 | hBDB-4G8.8 | CDR-L2 | GASNLES |
| 915 | hBDB-4G8.8 | CDR-L3 | QQSWNDPFT |
| 916 | hBDB-4G8.9 | VH | EVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARTNYYYRSYIFYFDYWGQGTMVTVSS |
| 917 | hBDB-4G8.9 | CDR-H1 | GYTFTNYGMY |
| 918 | hBDB-4G8.9 | CDR-H2 | WINTETGKPTYADDFKG |
| 919 | hBDB-4G8.9 | CDR-H3 | TNYYYRSYIFYFDY |
| 920 | hBDB-4G8.9 | VL | DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| 921 | hBDB-4G8.9 | CDR-L1 | RASESVSTHMH |
| 922 | hBDB-4G8.9 | CDR-L2 | GASNLES |
| 923 | hBDB-4G8.9 | CDR-L3 | QQSWNDPFT |
| 924 | hBEW-1B10.1 | VH | EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSS |
| 925 | hBEW-1B10.1 | CDR-H1 | GFSFSKYDMA |
| 926 | hBEW-1B10.1 | CDR-H2 | SITTSGVGTYYRDSVKG |
| 927 | hBEW-1B10.1 | CDR-H3 | GYGAMDA |
| 928 | hBEW-1B10.1 | VL | DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIK |
| 929 | hBEW-1B10.1 | CDR-L1 | KASQDIDDYLS |
| 930 | hBEW-1B10.1 | CDR-L2 | AATRLAD |
| 931 | hBEW-1B10.1 | CDR-L3 | LQSSSTPWT |
| 932 | hBEW-1B10.2 | VH | EVQLVESGGGLVQPGGSLRLSCAASGFSFSKYDMAWFRQAPGKGLEWVASITTSGVGTYYRDSVKGRFTVSRDNAKNSLYLQMNSLRAEDTAVYYCARGYGAMDAWGQGTTVTVSS |
| 933 | hBEW-1B10.2 | CDR-H1 | GFSFSKYDMA |
| 934 | hBEW-1B10.2 | CDR-H2 | SITTSGVGTYYRDSVKG |
| 935 | hBEW-1B10.2 | CDR-H3 | GYGAMDA |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 936 | hBEW-1B10.2 | VL | DIQMTQSPSSLSASVGDRVTITCKAS QDIDDYLSWYQQKPGKSPKLVIYAAT RLADGVPSRFSGSGSGTDYTLTISSL QPEDFATYYCLQSSSTPWTFGGGTKV EIK |
| 937 | hBEW-1B10.2 | CDR-L1 | KASQDIDDYLS |
| 938 | hBEW-1B10.2 | CDR-L2 | AATRLAD |
| 939 | hBEW-1B10.2 | CDR-L3 | LQSSSTPWT |
| 940 | hBEW-1E3.1 | VH | EIQLVQSGSELKKPGASVKVSCKASGYPFTNSGMYWVKQAPGQGLEYMGWIN TEAGKPTYADDFKGRFVFSLDTSVST AYLQISSLKAEDTAVYFCARWGYISD NSYGWFDYWGQGTLVTVSS |
| 941 | hBEW-1E3.1 | CDR-H1 | GYPFTNSGMY |
| 942 | hBEW-1E3.1 | CDR-H2 | WINTEAGKPTYADDFKG |
| 943 | hBEW-1E3.1 | CDR-H3 | WGYISDNSYGWFDY |
| 944 | hBEW-1E3.1 | VL | ETVLTQSPATLSLSPGERATLSCRAS EGVYSYMHWYQQKPGQQPRLLIYKAS NLASGVPARFSGSGSGTDFTLTISSL EPEDFAVYFCHQNWNDPLTFGQGTKL EIK |
| 945 | hBEW-1E3.1 | CDR-L1 | RASEGVYSYMH |
| 946 | hBEW-1E3.1 | CDR-L2 | KASNLAS |
| 947 | hBEW-1E3.1 | CDR-L3 | HQNWNDPLT |
| 948 | hBEW-1E3.2 | VH | EIQLVQSGAEVKKPGASVKVSCKASGYPFTNSGMYWVKQAPGQGLEYMGWIN TEAGKPTYADDFKGRFTFTLDTSTST AYLEIRSLRSDDTAVYFCARWGYISD NSYGWFDYWGQGTLVTVSS |
| 949 | hBEW-1E3.2 | CDR-H1 | GYPFTNSGMY |
| 950 | hBEW-1E3.2 | CDR-H2 | WINTEAGKPTYADDFKG |
| 951 | hBEW-1E3.2 | CDR-H3 | WGYISDNSYGWFDY |
| 952 | hBEW-1E3.2 | VL | ETVLTQSPATLSLSPGERATLSCRAS EGVYSYMHWYQQKPGQQPRLLIYKAS NLASGVPARFSGSGSGTDFTLTISSL EPEDFAVYFCHQNWNDPLTFGQGTKL EIK |
| 953 | hBEW-1E3.2 | CDR-L1 | RASEGVYSYMH |
| 954 | hBEW-1E3.2 | CDR-L2 | KASNLAS |
| 955 | hBEW-1E3.2 | CDR-L3 | HQNWNDPLT |
| 956 | hBEW-1E3.3 | VH | EVQLVQSGAEVKKPGASVKVSCKASGYPFTNSGMYWVRQAPGQGLEWMGWIN TEAGKPTYADDFKGRFTFTLDTSTST AYLEIRSLRSDDTAVYYCARWGYISD NSYGWFDYWGQGTLVTVSS |
| 957 | hBEW-1E3.3 | CDR-H1 | GYPFTNSGMY |
| 958 | hBEW-1E3.3 | CDR-H2 | WINTEAGKPTYADDFKG |
| 959 | hBEW-1E3.3 | CDR-H3 | WGYISDNSYGWFDY |

TABLE 27-continued

VH and VL Amino Acid Sequences of Humanized Rat Anti-Human VEGF-A Monoclonal Antibodies (CDRs in bold)

| SEQ ID NO: | Clone | Protein Region | V Region<br>12345678901234567890123456 7890 |
|---|---|---|---|
| 960 | hBEW-1E3.3 | VL | ETVLTQSPATLSLSPGERATLSCRAS EGVYSYMHWYQQKPGQQPRLLIYKAS NLASGVPARFSGSGSGTDFTLTISSL EPEDFAVYFCHQNWNDPLTFGQGTKL EIK |
| 961 | hBEW-1E3.3 | CDR-L1 | RASEGVYSYMH |
| 962 | hBEW-1E3.3 | CDR-L2 | KASNLAS |
| 963 | hBEW-1E3.3 | CDR-L3 | HQNWNDPLT |
| 964 | hBEW-1E3.4 | VH | EIQLVQSGSELKKPGASVKVSCKASG YPFTNSGMYWVKQAPGQGLEYMGWIN TEAGKPTYADDFKGRFVFSLDTSVST AYLQISSLKAEDTAVYFCARWGYISD NSYGWFDYWGQGTLVTVSS |
| 965 | hBEW-1E3.4 | CDR-H1 | GYPFTNSGMY |
| 966 | hBEW-1E3.4 | CDR-H2 | WINTEAGKPTYADDFKG |
| 967 | hBEW-1E3.4 | CDR-H3 | WGYISDNSYGWFDY |
| 968 | hBEW-1E3.4 | VL | ATQLTQSPSSLSASVGDRVTISCRAS EGVYSYMHWYQQKPGKQPKLLIYKAS NLASGVPSRFSGSGSGTDFTLTISSL QPEDFATYFCHQNWNDPLTFGQGTKL EIK |
| 969 | hBEW-1E3.4 | CDR-L1 | RASEGVYSYMH |
| 970 | hBEW-1E3.4 | CDR-L2 | KASNLAS |
| 971 | hBEW-1E3.4 | CDR-L3 | HQNWNDPLT |
| 972 | hBEW-1E3.5 | VH | EIQLVQSGAEVKKPGASVKVSCKASG YPFTNSGMYWVKQAPGQGLEYMGWIN TEAGKPTYADDFKGRFTFTLDTSTST AYLEIRSLRSDDTAVYFCARWGYISD NSYGWFDYWGQGTLVTVSS |
| 973 | hBEW-1E3.5 | CDR-H1 | GYPFTNSGMY |
| 974 | hBEW-1E3.5 | CDR-H2 | WINTEAGKPTYADDFKG |
| 975 | hBEW-1E3.5 | CDR-H3 | WGYISDNSYGWFDY |
| 976 | hBEW-1E3.5 | VL | ATQLTQSPSSLSASVGDRVTISCRAS EGVYSYMHWYQQKPGKQPKLLIYKAS NLASGVPSRFSGSGSGTDFTLTISSL QPEDFATYFCHQNWNDPLTFGQGTKL EIK |
| 977 | hBEW-1E3.5 | CDR-L1 | RASEGVYSYMH |
| 978 | hBEW-1E3.5 | CDR-L2 | KASNLAS |
| 979 | hBEW-1E3.5 | CDR-L3 | HQNWNDPLT |
| 980 | hBEW-5C3.1 | VH | EIQLVQSGSELKKPGASVKVSCKASG YTFTNYGVYWVKQAPGQGLEYMGWIN TETGKPTYADDFKGRFVFSLDTSVST AYLQISSLKAEDTAVYYCARARQLDW FVYWGQGTLVTVSS |
| 981 | hBEW-5C3.1 | CDR-H1 | GYTFTNYGVY |
| 982 | hBEW-5C3.1 | CDR-H2 | WINTETGKPTYADDFKG |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456 7890 |
|---|---|---|---|
| 983 | hBEW-5C3.1 | CDR-H3 | ARQLDWFVY |
| 984 | hBEW-5C3.1 VL | | DTVLTQSPATLSLSPGERATLSCRAR ESLTTSLSWFQQKPGQQPRLLIYGAS KLESGVPARFSGSGSGTDFTLTISSL EPEDFAVYFCQQSWYDPPTFGGGTKV EIK |
| 985 | hBEW-5C3.1 | CDR-L1 | RARESLTTSLS |
| 986 | hBEW-5C3.1 | CDR-L2 | GASKLES |
| 987 | hBEW-5C3.1 | CDR-L3 | QQSWYDPPT |
| 988 | hBEW-5C3.2 VH | | EIQLVQSGAEVKKPGSSVKVSCKASG YTFTNYGVYWVKQAPGQGLEYMGWIN TETGKPTYADDFKGRFTFTLDKSTST AYMELSSLRSEDTAVYFCARARQLDW FVYWGQGTLVTVSS |
| 989 | hBEW-5C3.2 | CDR-H1 | GYTFTNYGVY |
| 990 | hBEW-5C3.2 | CDR-H2 | WINTETGKPTYADDFKG |
| 991 | hBEW-5C3.2 | CDR-H3 | ARQLDWFVY |
| 992 | hBEW-5C3.2 VL | | DTVLTQSPATLSLSPGERATLSCRAR ESLTTSLSWFQQKPGQQPRLLIYGAS KLESGVPARFSGSGSGTDFTLTISSL EPEDFAVYFCQQSWYDPPTFGGGTKV EIK |
| 993 | hBEW-5C3.2 | CDR-L1 | RARESLTTSLS |
| 994 | hBEW-5C3.2 | CDR-L2 | GASKLES |
| 995 | hBEW-5C3.2 | CDR-L3 | QQSWYDPPT |
| 996 | hBEW-5C3.3 VH | | EVQLVQSGAEVKKPGSSVKVSCKASG YTFTNYGVYWVRQAPGQGLEWMGWIN TETGKPTYADDFKGRFTFTLDKSTST AYMELSSLRSEDTAVYYCARARQLDW FVYWGQGTLVTVSS |
| 997 | hBEW-5C3.3 | CDR-H1 | GYTFTNYGVY |
| 998 | hBEW-5C3.3 | CDR-H2 | WINTETGKPTYADDFKG |
| 999 | hBEW-5C3.3 | CDR-H3 | ARQLDWFVY |
| 1000 | hBEW-5C3.3 VL | | DTVLTQSPATLSLSPGERATLSCRAR ESLTTSLSWFQQKPGQQPRLLIYGAS KLESGVPARFSGSGSGTDFTLTISSL EPEDFAVYFCQQSWYDPPTFGGGTKV EIK |
| 1001 | hBEW-5C3.3 | CDR-L1 | RARESLTTSLS |
| 1002 | hBEW-5C3.3 | CDR-L2 | GASKLES |
| 1003 | hBEW-5C3.3 | CDR-L3 | QQSWYDPPT |
| 1004 | hBEW-5C3.4 VH | | EIQLVQSGSELKKPGASVKVSCKASG YTFTNYGVYWVKQAPGQGLEYMGWIN TETGKPTYADDFKGRFVFSLDTSVST AYLQISSLKAEDTAVYYCARARQLDW FVYWGQGTLVTVSS |
| 1005 | hBEW-5C3.4 | CDR-H1 | GYTFTNYGVY |
| 1006 | hBEW-5C3.4 | CDR-H2 | WINTETGKPTYADDFKG |
| 1007 | hBEW-5C3.4 | CDR-H3 | ARQLDWFVY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1008 | hBEW-5C3.4 | VL | DTQLTQSPSSLSASVGDRVTISCRAR ESLTTSLSWFQQKPGKQPKLLIYGAS KLESGVPSRFSGSGSGTDFTLTISSL QPEDFATYFCQQSWYDPPTFGGGTKV EIK |
| 1009 | hBEW-5C3.4 | CDR-L1 | RARESLTTSLS |
| 1010 | hBEW-5C3.4 | CDR-L2 | GASKLES |
| 1011 | hBEW-5C3.4 | CDR-L3 | QQSWYDPPT |
| 1012 | hBEW-5C3.5 | VH | EIQLVQSGAEVKKPGSSVKVSCKASG YTFTNYGVYWVKQAPGQGLEYMGWIN TETGKPTYADDFKGRFTFTLDKSTST AYMELSSLRSEDTAVYFCARARQLDW FVYWGQGTLVTVSS |
| 1013 | hBEW-5C3.5 | CDR-H1 | GYTFTNYGVY |
| 1014 | hBEW-5C3.5 | CDR-H2 | WINTETGKPTYADDFKG |
| 1015 | hBEW-5C3.5 | CDR-H3 | ARQLDWFVY |
| 1016 | hBEW-5C3.5 | VL | DTQLTQSPSSLSASVGDRVTISCRAR ESLTTSLSWFQQKPGKQPKLLIYGAS KLESGVPSRFSGSGSGTDFTLTISSL QPEDFATYFCQQSWYDPPTFGGGTKV EIK |
| 1017 | hBEW-5C3.5 | CDR-L1 | RARESLTTSLS |
| 1018 | hBEW-5C3.5 | CDR-L2 | GASKLES |
| 1019 | hBEW-5C3.5 | CDR-L3 | QQSWYDPPT |
| 1020 | hBEW-5C3.6 | VH | EVQLVQSGAEVKKPGSSVKVSCKASG YTFTNYGVYWVRQAPGQGLEWMGWIN TETGKPTYADDFKGRFTFTLDKSTST AYMELSSLRSEDTAVYYCARARQLDW FVYWGQGTLVTVSS |
| 1021 | hBEW-5C3.6 | CDR-H1 | GYTFTNYGVY |
| 1022 | hBEW-5C3.6 | CDR-H2 | WINTETGKPTYADDFKG |
| 1023 | hBEW-5C3.6 | CDR-H3 | ARQLDWFVY |
| 1024 | hBEW-5C3.6 | VL | DTQLTQSPSSLSASVGDRVTISCRAR ESLTTSLSWFQQKPGKQPKLLIYGAS KLESGVPSRFSGSGSGTDFTLTISSL QPEDFATYFCQQSWYDPPTFGGGTKV EIK |
| 1025 | hBEW-5C3.6 | CDR-L1 | RARESLTTSLS |
| 1026 | hBEW-5C3.6 | CDR-L2 | GASKLES |
| 1027 | hBEW-5C3.6 | CDR-L3 | QQSWYDPPT |
| 1028 | hBEW-6C2.1 | VH | EVQLVESGGGLVQPGGSLRLSCAASG FTFSYYGMHWVRQAPGKGLEWVALIY YDSSKMYYADSVKGRFTISRDNAKNS LYLQMNSLRAEDTAVYYCARGGTAPV YWGQGTMVTVSS |
| 1029 | hBEW-6C2.1 | CDR-H1 | GFTFSYYGMH |
| 1030 | hBEW-6C2.1 | CDR-H2 | LIYYDSSKMYYADSVKG |
| 1031 | hBEW-6C2.1 | CDR-H3 | GGTAPVY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 1234567890123456789012345678 90 |
|---|---|---|---|
| 1032 | hBEW-6C2.1 | VL | EIVLTQSPATLSLSPGERATLSCKGS QNIANYLAWYQQKPGQAPRLLIYNTD SLQTGIPARFSGSGSGTDFTLTISSL EPEDFAVYYCYQSNNGYTFGQGTKLE IK |
| 1033 | hBEW-6C2.1 | CDR-L1 | KGSQNIANYLA |
| 1034 | hBEW-6C2.1 | CDR-L2 | NTDSLQT |
| 1035 | hBEW-6C2.1 | CDR-L3 | YQSNNGYT |
| 1036 | hBEW-6C2.2 | VH | EVQLVESGGGLVQPGGSLRLSCAASG FTFSYYGMHWVRQAPGKGLEWVALIY YDSSKMYYADSVKGRFTISRDNAKNS LYLQMNSLRAEDTAVYYCARGGTAPV YWGQGTMVTVSS |
| 1037 | hBEW-6C2.2 | CDR-H1 | GFTFSYYGMH |
| 1038 | hBEW-6C2.2 | CDR-H2 | LIYYDSSKMYYADSVKG |
| 1039 | hBEW-6C2.2 | CDR-H3 | GGTAPVY |
| 1040 | hBEW-6C2.2 | VL | EIVLTQSPATLSLSPGERATLSCKGS QNIANYLAWYQQKPGQAPRLLIYNTD SLQTGIPARFSGSGSGTDYTLTISSL EPEDFAVYFCYQSNNGYTFGQGTKLE IK |
| 1041 | hBEW-6C2.2 | CDR-L1 | KGSQNIANYLA |
| 1042 | hBEW-6C2.2 | CDR-L2 | NTDSLQT |
| 1043 | hBEW-6C2.2 | CDR-L3 | YQSNNGYT |
| 1044 | hBEW-6C2.3 | VH | EVQLVESGGGLVQPGGSLRLSCAASG FTFSYYGMHWVRQAPGKGLEWVALIY YDSSKMYYADSVKGRFTISRDNAKNS LYLQMNSLRAEDTAVYYCARGGTAPV YWGQGTMVTVSS |
| 1045 | hBEW-6C2.3 | CDR-H1 | GFTFSYYGMH |
| 1046 | hBEW-6C2.3 | CDR-H2 | LIYYDSSKMYYADSVKG |
| 1047 | hBEW-6C2.3 | CDR-H3 | GGTAPVY |
| 1048 | hBEW-6C2.3 | VL | DIQMTQSPSSLSASVGDRVTITCKGS QNIANYLAWYQQKPGKAPKLLIYNTD SLQTGVPSRFSGSGSGTDFTLTISSL QPEDFATYYCYQSNNGYTFGQGTKLE IK |
| 1049 | hBEW-6C2.3 | CDR-L1 | KGSQNIANYLA |
| 1050 | hBEW-6C2.3 | CDR-L2 | NTDSLQT |
| 1051 | hBEW-6C2.3 | CDR-L3 | YQSNNGYT |
| 1052 | hBEW-6C2.4 | VH | EVQLVESGGGLVQPGGSLRLSCAASG FTFSYYGMHWVRQAPGKGLEWVALIY YDSSKMYYADSVKGRFTISRDNAKNS LYLQMNSLRAEDTAVYYCARGGTAPV YWGQGTMVTVSS |
| 1053 | hBEW-6C2.4 | CDR-H1 | GFTFSYYGMH |
| 1054 | hBEW-6C2.4 | CDR-H2 | LIYYDSSKMYYADSVKG |
| 1055 | hBEW-6C2.4 | CDR-H3 | GGTAPVY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1056 | hBEW-6C2.4 | VL | DIQLTQSPSSLSASVGDRVTITCKGS QNIANYLAWYQQKPGKAPKLLIYNTD SLQTGIPSRFSGSGSGTDYTLTISSL QPEDFATYFCYQSNNGYTFGQGTKLE IK |
| 1057 | hBEW-6C2.4 | CDR-L1 | KGSQNIANYLA |
| 1058 | hBEW-6C2.4 | CDR-L2 | NTDSLQT |
| 1059 | hBEW-6C2.4 | CDR-L3 | YQSNNGYT |
| 1060 | hBEW-6C2.5 | VH | EVQLVESGGGLVQPGGSLRLSCAASGFTFSYYGMHWIRQAPGKGLEWMALIY YDSSKMYYADSVKGRFTISRDNAKNS LYLQMNSLRAEDTAVYYCAAGGTAPV YWGQGTMVTVSS |
| 1061 | hBEW-6C2.5 | CDR-H1 | GFTFSYYGMH |
| 1062 | hBEW-6C2.5 | CDR-H2 | LIYYDSSKMYYADSVKG |
| 1063 | hBEW-6C2.5 | CDR-H3 | GGTAPVY |
| 1064 | hBEW-6C2.5 | VL | EIVLTQSPATLSLSPGERATLSCKGS QNIANYLAWYQQKPGQAPRLLIYNTD SLQTGIPARFSGSGSGTDFTLTISSL EPEDFAVYYCYQSNNGYTFGQGTKLE IK |
| 1065 | hBEW-6C2.5 | CDR-L1 | KGSQNIANYLA |
| 1066 | hBEW-6C2.5 | CDR-L2 | NTDSLQT |
| 1067 | hBEW-6C2.5 | CDR-L3 | YQSNNGYT |
| 1068 | hBEW-6C2.6 | VH | EVQLVESGGGLVQPGGSLRLSCAASGFTFSYYGMHWIRQAPGKGLEWMALIY YDSSKMYYADSVKGRFTISRDNAKNS LYLQMNSLRAEDTAVYYCAAGGTAPV YWGQGTMVTVSS |
| 1069 | hBEW-6C2.6 | CDR-H1 | GFTFSYYGMH |
| 1070 | hBEW-6C2.6 | CDR-H2 | LIYYDSSKMYYADSVKG |
| 1071 | hBEW-6C2.6 | CDR-H3 | GGTAPVY |
| 1072 | hBEW-6C2.6 | VL | EIVLTQSPATLSLSPGERATLSCKGS QNIANYLAWYQQKPGQAPRLLIYNTD SLQTGIPARFSGSGSGTDYTLTISSL EPEDFAVYFCYQSNNGYTFGQGTKLE IK |
| 1073 | hBEW-6C2.6 | CDR-L1 | KGSQNIANYLA |
| 1074 | hBEW-6C2.6 | CDR-L2 | NTDSLQT |
| 1075 | hBEW-6C2.6 | CDR-L3 | YQSNNGYT |
| 1076 | hBEW-6C2.7 | VH | EVQLVESGGGLVQPGGSLRLSCAASGFTFSYYGMHWIRQAPGKGLEWMALIY YDSSKMYYADSVKGRFTISRDNAKNS LYLQMNSLRAEDTAVYYCAAGGTAPV YWGQGTMVTVSS |
| 1077 | hBEW-6C2.7 | CDR-H1 | GFTFSYYGMH |
| 1078 | hBEW-6C2.7 | CDR-H2 | LIYYDSSKMYYADSVKG |
| 1079 | hBEW-6C2.7 | CDR-H3 | GGTAPVY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1080 | hBEW-6C2.7 | VL | DIQMTQSPSSLSASVGDRVTITCKGS QNIANYLAWYQQKPGKAPKLLIYNTD SLQTGVPSRFSGSGSGTDFTLTISSL QPEDFATYYCYQSNNGYTFGQGTKLE IK |
| 1081 | hBEW-6C2.7 | CDR-L1 | KGSQNIANYLA |
| 1082 | hBEW-6C2.7 | CDR-L2 | NTDSLQT |
| 1083 | hBEW-6C2.7 | CDR-L3 | YQSNNGYT |
| 1084 | hBEW-6C2.8 | VH | EVQLVESGGGLVQPGGSLRLSCAASG FTFSYYGMHWIRQAPGKGLEWMALIY YDSSKMYYADSVKGRFTISRDNAKNS LYLQMNSLRAEDTAVYYCAAGGTAPV YWGQGTMVTVSS |
| 1085 | hBEW-6C2.8 | CDR-H1 | GFTFSYYGMH |
| 1086 | hBEW-6C2.8 | CDR-H2 | LIYYDSSKMYYADSVKG |
| 1087 | hBEW-6C2.8 | CDR-H3 | GGTAPVY |
| 1088 | hBEW-6C2.8 | VL | DIQLTQSPSSLSASVGDRVTITCKGS QNIANYLAWYQQKPGKAPKLLIYNTD SLQTGIPSRFSGSGSGTDYTLTISSL QPEDFATYFCYQSNNGYTFGQGTKLE IK |
| 1089 | hBEW-6C2.8 | CDR-L1 | KGSQNIANYLA |
| 1090 | hBEW-6C2.8 | CDR-L2 | NTDSLQT |
| 1091 | hBEW-6C2.8 | CDR-L3 | YQSNNGYT |
| 1092 | hBEW-9A8.1 | VH | EVQLVQSGHEVKQPGASVKVSCKASG YTFTNYGMYWVPQAPGQGLEWMGWIN TETGKPIYADDFKGRFVFSMDTSAST AYLQISSLKAEDMAMYYCARVDYDGS FWFAYWGQGTLVTVSS |
| 1093 | hBEW-9A8.1 | CDR-H1 | GYTFTNYGMY |
| 1094 | hBEW-9A8.1 | CDR-H2 | WINTETGKPIYADDFKG |
| 1095 | hBEW-9A8.1 | CDR-H3 | VDYDGSFWFAY |
| 1096 | hBEW-9A8.1 | VL | EIVLTQSPDFQSVTPKEKVTITCRAS ESVSTVIHWYQQKPDQSPKLLIKPGAS NLESGVPSRFSGSGSGTDFTLTINSL EAEDAATYYCQQHWNDPPTFGQGTKL EIK |
| 1097 | hBEW-9A8.1 | CDR-L1 | RASESVSTVIH |
| 1098 | hBEW-9A8.1 | CDR-L2 | GASNLES |
| 1099 | hBEW-9A8.1 | CDR-L3 | QQHWNDPPT |
| 1100 | hBEW-9A8.10 | VH | EVQLVQSGAEVKKPGASVKVSCKASG YTFTNYGMYWVRQAPGQGLEWMGWIN TETGKPIYADDFKGRVTMTTDTSTST AYMELRSLRSDDTAVYYCARVDYDGS FWFAYWGQGTLVTVSS |
| 1101 | hBEW-9A8.10 | CDR-H1 | GYTFTNYGMY |
| 1102 | hBEW-9A8.10 | CDR-H2 | WINTETGKPIYADDFKG |
| 1103 | hBEW-9A8.10 | CDR-H3 | VDYDGSFWFAY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890 1234567890 |
|---|---|---|---|
| 1104 | hBEW-9A8.10 | VL | ETVLTQSPDFQSVTPKEKVTITCRAS ESVSTVIHWYQQKPDQQPKLLIHGAS NLESGVPSRFSGSGSGTDFTLTINSL EAEDAATYFCQQHWNDPPTFGQGTKL EIK |
| 1105 | hBEW-9A8.10 | CDR-L1 | RASESVSTVIH |
| 1106 | hBEW-9A8.10 | CDR-L2 | GASNLES |
| 1107 | hBEW-9A8.10 | CDR-L3 | QQHWNDPPT |
| 1108 | hBEW-9A8.11 | VH | EVQLVQSGAEVKKPGASVKVSCKASG YTFTNYGMYWVRQAPGQGLEWMGWIN TETGKPIYADDFKGRVTMTTDTSTST AYMELRSLRSDDTAVYYCARVDYDGS FWFAYWGQGTLVTVSS |
| 1109 | hBEW-9A8.11 | CDR-H1 | GYTFTNYGMY |
| 1110 | hBEW-9A8.11 | CDR-H2 | WINTETGKPIYADDFKG |
| 1111 | hBEW-9A8.11 | CDR-H3 | VDYDGSFWFAY |
| 1112 | hBEW-9A8.11 | VL | DIQMTQSPSSLSASVGDRVTITCRAS ESVSTVIHWYQQKPGKAPKLLIYGAS NLESGVPSRFSGSGSGTDFTLTISSL QPEDFATYYCQQHWNDPPTFGQGTKL EIK |
| 1113 | hBEW-9A8.11 | CDR-L1 | RASESVSTVIH |
| 1114 | hBEW-9A8.11 | CDR-L2 | GASNLES |
| 1115 | hBEW-9A8.11 | CDR-L3 | QQHWNDPPT |
| 1116 | hBEW-9A8.12 | VH | EVQLVQSGAEVKKPGASVKVSCKASG YTFTNYGMYWVRQAPGQGLEWMGWIN TETGKPIYADDFKGRVTMTTDTSTST AYMELRSLRSDDTAVYYCARVDYDGS FWFAYWGQGTLVTVSS |
| 1117 | hBEW-9A8.12 | CDR-H1 | GYTFTNYGMY |
| 1118 | hBEW-9A8.12 | CDR-H2 | WINTETGKPIYADDFKG |
| 1119 | hBEW-9A8.12 | CDR-H3 | VDYDGSFWFAY |
| 1120 | hBEW-9A8.12 | VL | DTQLTQSPSSLSASVGDRVTITCRAS ESVSTVIHWYQQKPGKQPKLLIHGAS NLESGVPSRFSGSGSGTDFTLTISSL QPEDFATYFCQQHWNDPPT**FGQGTKL EIK |
| 1121 | hBEW-9A8.12 | CDR-L1 | RASESVSTVIH |
| 1122 | hBEW-9A8.12 | CDR-L2 | GASNLES |
| 1123 | hBEW-9A8.12 | CDR-L3 | QQHWNDPPT |
| 1124 | hBEW-9A8.13 | VH | EIQLVQSGAEVKKPGASVKVSCKASG YTFTNYGMYWVKQAPGQGLEYMGWIN TETGKPIYADDFKGRFTFTLDTSTST AYMELRSLRSDDTAVFFCARVDYDGS FWFAYWGQGTLVTVSS |
| 1125 | hBEW-9A8.13 | CDR-H1 | GYTFTNYGMY |
| 1126 | hBEW-9A8.13 | CDR-H2 | WINTETGKPIYADDFKG |
| 1127 | hBEW-9A8.13 | CDR-H3 | VDYDGSFWFAY |

TABLE 27-continued

VH and VL Amino Acid Sequences of Humanized Rat Anti-Human VEGF-A Monoclonal Antibodies (CDRs in bold)

| SEQ ID NO: | Clone | Protein Region | V Region 12345678901234567890123456789 0 |
|---|---|---|---|
| 1128 | hBEW-9A8.13 | VL | EIVLTQSPDFQSVTPKEKVTITCRAS ESVSTVIHWYQQKPDQSPKLLIKGAS NLESGVPSRFSGSGSGTDFTLTINSL EAEDAATYYCQQHWNDPPTFGQGTKL EIK |
| 1129 | hBEW-9A8.13 | CDR-L1 | RASESVSTVIH |
| 1130 | hBEW-9A8.13 | CDR-L2 | GASNLES |
| 1131 | hBEW-9A8.13 | CDR-L3 | QQHWNDPPT |
| 1132 | hBEW-9A8.14 | VH | EIQLVQSGAEVKKPGASVKVSCKASG YTFTNYGMYWVKQAPGQGLEYMGWIN TETGKPIYADDFKGRFTFTLDTSTST AYMELRSLRSDDTAVFFCARVDYDGS FWFAYWGQGTLVTVSS |
| 1133 | hBEW-9A8.14 | CDR-H1 | GYTFTNYGMY |
| 1134 | hBEW-9A8.14 | CDR-H2 | WINTETGKPIYADDFKG |
| 1135 | hBEW-9A8.14 | CDR-H3 | VDYDGSFWFAY |
| 1136 | hBEW-9A8.14 | VL | ETVLTQSPDFQSVTPKEKVTITCRAS ESVSTVIHWYQQKPDQQPKLLIHGAS NLESGVPSRFSGSGSGTDFTLTINSL EAEDAATYFCQQHWNDPPTFGQGTKL EIK |
| 1137 | hBEW-9A8.14 | CDR-L1 | RASESVSTVIH |
| 1138 | hBEW-9A8.14 | CDR-L2 | GASNLES |
| 1139 | hBEW-9A8.14 | CDR-L3 | QQHWNDPPT |
| 1140 | hBEW-9A8.15 | VH | EIQLVQSGAEVKKPGASVKVSCKASG YTFTNYGMYWVKQAPGQGLEYMGWIN TETGKPIYADDFKGRFTFTLDTSTST AYMELRSLRSDDTAVFFCARVDYDGS FWFAYWGQGTLVTVSS |
| 1141 | hBEW-9A8.15 | CDR-H1 | GYTFTNYGMY |
| 1142 | hBEW-9A8.15 | CDR-H2 | WINTETGKPIYADDFKG |
| 1143 | hBEW-9A8.15 | CDR-H3 | VDYDGSFWFAY |
| 1144 | hBEW-9A8.15 | VL | DIQMTQSPSSLSASVGDRVTITCRAS ESVSTVIHWYQQKPGKAPKLLIYGAS NLESGVPSRFSGSGSGTDFTLTISSL QPEDFATYYCQQHWNDPPTFGQGTKL EIK |
| 1145 | hBEW-9A8.15 | CDR-L1 | RASESVSTVIH |
| 1146 | hBEW-9A8.15 | CDR-L2 | GASNLES |
| 1147 | hBEW-9A8.15 | CDR-L3 | QQHWNDPPT |
| 1148 | hBEW-9A8.16 | VH | EIQLVQSGAEVKKPGASVKVSCKASG YTFTNYGMYWVKQAPGQGLEYMGWIN TETGKPIYADDFKGRFTFTLDTSTST AYMELRSLRSDDTAVFFCARVDYDGS FWFAYWGQGTLVTVSS |
| 1149 | hBEW-9A8.16 | CDR-H1 | GYTFTNYGMY |
| 1150 | hBEW-9A8.16 | CDR-H2 | WINTETGKPIYADDFKG |
| 1151 | hBEW-9A8.16 | CDR-H3 | VDYDGSFWFAY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456 7890 |
|---|---|---|---|
| 1152 | hBEW-9A8.16 | VL | DTQLTQSPSSLSASVGDRVTITCRAS ESVSTVIHWYQQKPGKQPKLLIHGAS NLESGVPSRFSGSGSGTDFTLTISSL QPEDFATYFCQQHWNDPPTFGQGTKL EIK |
| 1153 | hBEW-9A8.16 | CDR-L1 | RASESVSTVIH |
| 1154 | hBEW-9A8.16 | CDR-L2 | GASNLES |
| 1155 | hBEW-9A8.16 | CDR-L3 | QQHWNDPPT |
| 1156 | hBEW-9A8.17 | VH | EIQLVQSGSELKKPGASVKVSCKASG YTFTNYGMYWVKQAPGQGLEYMGWIN TETGKPIYADDFKGRFVFSLDTSVST AYLQISSLKAEDTAVYYCARVDYDGS FWFAYWGQGTLVTVSS |
| 1157 | hBEW-9A8.17 | CDR-H1 | GYTFTNYGMY |
| 1158 | hBEW-9A8.17 | CDR-H2 | WINTETGKPIYADDFKG |
| 1159 | hBEW-9A8.17 | CDR-H3 | VDYDGSFWFAY |
| 1160 | hBEW-9A8.17 | VL | ETVLTQSPATLSLSPGERATLSGRAS ESVSTVIHWYQQKPGQQPRLLIHGAS NLESGVPARFSGSGSGTDFTLTISSL EPEDFAVYFCQQHWNDPPTFGQGTKL EIK |
| 1161 | hBEW-9A8.17 | CDR-L1 | RASESVSTVIH |
| 1162 | hBEW-9A8.17 | CDR-L2 | GASNLES |
| 1163 | hBEW-9A8.17 | CDR-L3 | QQHWNDPPT |
| 1164 | hBEW-9A8.2 | VH | EVQLVQSGHEVKQPGASVKVSCKASG YTFTNYGMYWVPQAPGQGLEWMGWIN TETGKPIYADDFKGRFVFSMDTSAST AYLQISSLKAEDMAMYYCARVDYDGS FWFAYWGQGTLVTVSS |
| 1165 | hBEW-9A8.2 | CDR-H1 | GYTFTNYGMY |
| 1166 | hBEW-9A8.2 | CDR-H2 | WINTETGKPIYADDFKG |
| 1167 | hBEW-9A8.2 | CDR-H3 | VDYDGSFWFAY |
| 1168 | hBEW-9A8.2 | VL | ETVLTQSPDFQSVTPKEKVTITGRAS ESVSTVIHWYQQKPDQQPKLLIHGAS NLESGVPSRFSGSGSGTDFTLTINSL EAEDAATYFCQQHWNDPPTFGQGTKL EIK |
| 1169 | hBEW-9A8.2 | CDR-L1 | RASESVSTVIH |
| 1170 | hBEW-9A8.2 | CDR-L2 | GASNLES |
| 1171 | hBEW-9A8.2 | CDR-L3 | QQHWNDPPT |
| 1172 | hBEW-9A8.20 | VH | EIQLVQSGAEVKKPGASVKVSCKASG YTFTNYGMYWVKQAPGQGLEYMGWIN TETGKPIYADDFKGRFTFTLDTSTST AYMELRSLRSDDTAVYYCARVDYDGS FWFAYWGQGTLVTVSS |
| 1173 | hBEW-9A8.20 | CDR-H1 | GYTFTNYGMY |
| 1174 | hBEW-9A8.20 | CDR-H2 | WINTETGKPIYADDFKG |
| 1175 | hBEW-9A8.20 | CDR-H3 | VDYDGSFWFAY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1176 | hBEW-9A8.20 | VL | ETVLTQSPATLSLSPGERATLSCRAS ESVSTVIHWYQQKPGQQPRLLIHGAS NLESGVPARFSGSGSGTDFTLTISSL EPEDFAVYFCQQHWNDPPTFGQGTKL EIK |
| 1177 | hBEW-9A8.20 | CDR-L1 | RASESVSTVIH |
| 1178 | hBEW-9A8.20 | CDR-L2 | GASNLES |
| 1179 | hBEW-9A8.20 | CDR-L3 | QQHWNDPPT |
| 1180 | hBEW-9A8.21 | VH | EIQLVQSGAEVKKPGASVKVSCKASG YTFTNYGMYWVRQAPGQGLEWMGWIN TETGKPIYADDFKGRFTFTLDTSTST AYMELRSLRSDDTAVYYCARVDYDGS FWFAYWGQGTLVTVSS |
| 1181 | hBEW-9A8.21 | CDR-H1 | GYTFTNYGMY |
| 1182 | hBEW-9A8.21 | CDR-H2 | WINTETGKPIYADDFKG |
| 1183 | hBEW-9A8.21 | CDR-H3 | VDYDGSFWFAY |
| 1184 | hBEW-9A8.21 | VL | ETVLTQSPATLSLSPGERATLSCRAS ESVSTVIHWYQQKPGQQPRLLIHGAS NLESGVPARFSGSGSGTDFTLTISSL EPEDFAVYFCQQHWNDPPTFGQGTKL EIK |
| 1185 | hBEW-9A8.21 | CDR-L1 | RASESVSTVIH |
| 1186 | hBEW-9A8.21 | CDR-L2 | GASNLES |
| 1187 | hBEW-9A8.21 | CDR-L3 | QQHWNDPPT |
| 1188 | hBEW-9A8.3 | VH | EVQLVQSGHEVKQPGASVKVSCKASG YTFTNYGMYWVPQAPGQGLEWMGWIN TETGKPIYADDFKGRFVFSMDTSAST AYLQISSLKAEDMAMYYCARVDYDGS FWFAYWGQGTLVTVSS |
| 1189 | hBEW-9A8.3 | CDR-H1 | GYTFTNYGMY |
| 1190 | hBEW-9A8.3 | CDR-H2 | WINTETGKPIYADDFKG |
| 1191 | hBEW-9A8.3 | CDR-H3 | VDYDGSFWFAY |
| 1192 | hBEW-9A8.3 | VL | DIQMTQSPSSLSASVGDRVTITCRAS ESVSTVIHWYQQKPGKAPKLLIYGAS NLESGVPSRFSGSGSGTDFTLTISSL QPEDFATYYCQQHWNDPPTFGQGTKL EIK |
| 1193 | hBEW-9A8.3 | CDR-L1 | RASESVSTVIH |
| 1194 | hBEW-9A8.3 | CDR-L2 | GASNLES |
| 1195 | hBEW-9A8.3 | CDR-L3 | QQHWNDPPT |
| 1196 | hBEW-9A8.4 | VH | EVQLVQSGHEVKQPGASVKVSCKASG YTFTNYGMYWVPQAPGQGLEWMGWIN TETGKPIYADDFKGRFVFSMDTSAST AYLQISSLKAEDMAMYYCARVDYDGS FWFAYWGQGTLVTVSS |
| 1197 | hBEW-9A8.4 | CDR-H1 | GYTFTNYGMY |
| 1198 | hBEW-9A8.4 | CDR-H2 | WINTETGKPIYADDFKG |
| 1199 | hBEW-9A8.4 | CDR-H3 | VDYDGSFWFAY |

TABLE 27-continued

VH and VL Amino Acid Sequences of Humanized Rat Anti-Human VEGF-A Monoclonal Antibodies (CDRs in bold)

| SEQ ID NO: | Clone | Protein Region | V Region 12345678901234567890123456789 0 |
|---|---|---|---|
| 1200 | hBEW-9A8.4 | VL | DTQLTQSPSSLSASVGDRVTITCRAS ESVSTVIHWYQQKPGKQPKLLIHGAS NLESGVPSRFSGSGSGTDFTLTISSL QPEDFATYCQQHWNDPPTFGQGTKL EIK |
| 1201 | hBEW-9A8.4 | CDR-L1 | RASESVSTVIH |
| 1202 | hBEW-9A8.4 | CDR-L2 | GASNLES |
| 1203 | hBEW-9A8.4 | CDR-L3 | QQHWNDPPT |
| 1204 | hBEW-9A8.5 | VH | EIQLVQSGHEVKQPGASVKVSCKASG YTFTNYGMYWVKQAPGQGLEYMGWIN TETGKPIYADDFKGRFVFSLDTSAST AYLQISSLKAEDMAMFFCARVDYDGS FWFAYWGQGTLVTVSS |
| 1205 | hBEW-9A8.5 | CDR-H1 | GYTFTNYGMY |
| 1206 | hBEW-9A8.5 | CDR-H2 | WINTETGKPIYADDFKG |
| 1207 | hBEW-9A8.5 | CDR-H3 | VDYDGSFWFAY |
| 1208 | hBEW-9A8.5 | VL | EIVLTQSPDFQSVTPKEKVTITCRAS ESVSTVIHWYQQKPDQSPKLLIKGAS NLESGVPSRFSGSGSGTDFTLTINSL EAEDAATYYCQQHWNDPPTFGQGTKL EIK |
| 1209 | hBEW-9A8.5 | CDR-L1 | RASESVSTVIH |
| 1210 | hBEW-9A8.5 | CDR-L2 | GASNLES |
| 1211 | hBEW-9A8.5 | CDR-L3 | QQHWNDPPT |
| 1212 | hBEW-9A8.6 | VH | EIQLVQSGHEVKQPGASVKVSCKASG YTFTNYGMYWVKQAPGQGLEYMGWIN TETGKPIYADDFKGRFVFSLDTSAST AYLQISSLKAEDMAMFFCARVDYDGS FWFAYWGQGTLVTVSS |
| 1213 | hBEW-9A8.6 | CDR-H1 | GYTFTNYGMY |
| 1214 | hBEW-9A8.6 | CDR-H2 | WINTETGKPIYADDFKG |
| 1215 | hBEW-9A8.6 | CDR-H3 | VDYDGSFWFAY |
| 1216 | hBEW-9A8.6 | VL | ETVLTQSPDFQSVTPKEKVTITCRAS ESVSTVIHWYQQKPDQQPKLLIHGAS NLESGVPSRFSGSGSGTDFTLTINSL EAEDAATYFCQQHWNDPPTFGQGTKL EIK |
| 1217 | hBEW-9A8.6 | CDR-L1 | RASESVSTVIH |
| 1218 | hBEW-9A8.6 | CDR-L2 | GASNLES |
| 1219 | hBEW-9A8.6 | CDR-L3 | QQHWNDPPT |
| 1220 | hBEW-9A8.7 | VH | EIQLVQSGHEVKQPGASVKVSCKASG YTFTNYGMYWVKQAPGQGLEYMGWIN TETGKPIYADDFKGRFVFSLDTSAST AYLQISSLKAEDMAMFFCARVDYDGS FWFAYWGQGTLVTVSS |
| 1221 | hBEW-9A8.7 | CDR-H1 | GYTFTNYGMY |
| 1222 | hBEW-9A8.7 | CDR-H2 | WINTETGKPIYADDFKG |
| 1223 | hBEW-9A8.7 | CDR-H3 | VDYDGSFWFAY |

TABLE 27-continued

VH and VL Amino Acid Sequences of Humanized Rat Anti-Human VEGF-A Monoclonal Antibodies (CDRs in bold)

| SEQ ID NO: | Clone | Protein Region | V Region 12345678901234567890123456 7890 |
|---|---|---|---|
| 1224 | hBEW-9A8.7 | VL | DIQMTQSPSSLSASVGDRVTITCRAS ESVSTVIHWYQQKPGKAPKLLIYGAS NLESGVPSRFSGSGSGTDFTLTISSL QPEDFATYYCQQHWNDPPTFGQGTKL EIK |
| 1225 | hBEW-9A8.7 | CDR-L1 | RASESVSTVIH |
| 1226 | hBEW-9A8.7 | CDR-L2 | GASNLES |
| 1227 | hBEW-9A8.7 | CDR-L3 | QQHWNDPPT |
| 1228 | hBEW-9A8.8 | VH | EIQLVQSGHEVKQPGASVKVSCKASG YTFTNYGMYWVKQAPGQGLEYMGWIN TETGKPIYADDFKGRFVFSLDTSAST AYLQISSLKAEDMAMFFCARVDYDGS FWFAYWGQGTLVTVSS |
| 1229 | hBEW-9A8.8 | CDR-H1 | GYTFTNYGMY |
| 1230 | hBEW-9A8.8 | CDR-H2 | WINTETGKPIYADDFKG |
| 1231 | hBEW-9A8.8 | CDR-H3 | VDYDGSFWFAY |
| 1232 | hBEW-9A8.8 | VL | DTQLTQSPSSLSASVGDRVTITCRAS ESVSTVIHWYQQKPGKQPKLLIHGAS NLESGVPSRFSGSGSGTDFTLTISSL QPEDFATYFCQQHWNDPPTFGQGTKL EIK |
| 1233 | hBEW-9A8.8 | CDR-L1 | RASESVSTVIH |
| 1234 | hBEW-9A8.8 | CDR-L2 | GASNLES |
| 1235 | hBEW-9A8.8 | CDR-L3 | QQHWNDPPT |
| 1236 | hBEW-9A8.9 | VH | EVQLVQSGAEVKKPGASVKVSCKASG YTFTNYGMYWVRQAPGQGLEWMGWIN TETGKPIYADDFKGRVTMTTDTSTST AYMELRSLRSDDTAVYYCARVDYDGS FWFAYWGQGTLVTVSS |
| 1237 | hBEW-9A8.9 | CDR-H1 | GYTFTNYGMY |
| 1238 | hBEW-9A8.9 | CDR-H2 | WINTETGKPIYADDFKG |
| 1239 | hBEW-9A8.9 | CDR-H3 | VDYDGSFWFAY |
| 1240 | hBEW-9A8.9 | VL | EIVLTQSPDFQSVTPKEKVTITCRAS ESVSTVIHWYQQKPDQSPKLLIKGAS NLESGVPSRFSGSGSGTDFTLTINSL EAEDAATYYCQQHWNDPPTFGQGTKL EIK |
| 1241 | hBEW-9A8.9 | CDR-L1 | RASESVSTVIH |
| 1242 | hBEW-9A8.9 | CDR-L2 | GASNLES |
| 1243 | hBEW-9A8.9 | CDR-L3 | QQHWNDPPT |
| 1244 | hBEW-9E10.1 | VH | EIQLVQSGSELKKPGASVKVSCKASG YTFTNYGMYWVKQAPGQGLEYMGWID TETGRPTYADDFKGRFVFSLDTSVST AYLQISSLKAEDTAVYFCARWSGDTT GIRGPWFAYWGQGTLVTVSS |
| 1245 | hBEW-9E10.1 | CDR-H1 | GYTFTNYGMY |
| 1246 | hBEW-9E10.1 | CDR-H2 | WIDTETGRPTYADDFKG |
| 1247 | hBEW-9E10.1 | CDR-H3 | WSGDTTGIRGPWFAY |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1248 | hBEW-9E10.1 | VL | DIRMTQSPSSLSASVGDRVTIECLAS EDIYSDLAWYQQKPGKSPKLLIYNAN GLQNGVPSRFSGSGSGTDYSLTISSL QPEDVATYFCQQYNYFPGTFGQGTKL EIK |
| 1249 | hBEW-9E10.1 | CDR-L1 | LASEDIYSDLA |
| 1250 | hBEW-9E10.1 | CDR-L2 | NANGLQN |
| 1251 | hBEW-9E10.1 | CDR-L3 | QQYNYFPGT |
| 1252 | hBEW-9E10.2 | VH | EIQLVQSGAEVKKPGSSVKVSCKASG YTFTNYGMYWVKQAPGQGLEYMGWID TETGRPTYADDFKGRFTFTADKSTST AYMELSSLRSEDTAVYFCARWSGDTT GIRGPWFAYWGQGTLVTVSS |
| 1253 | hBEW-9E10.2 | CDR-H1 | GYTFTNYGMY |
| 1254 | hBEW-9E10.2 | CDR-H2 | WIDTETGRPTYADDFKG |
| 1255 | hBEW-9E10.2 | CDR-H3 | WSGDTTGIRGPWFAY |
| 1256 | hBEW-9E10.2 | VL | DIRMTQSPSSLSASVGDRVTIECLAS EDIYSDLAWYQQKPGKSPKLLTYNAN GLQNGVPSRFSGSGSGTDYSLTISSL QPEDVATYFCQQYNYFPGTFGQGTKL EIK |
| 1257 | hBEW-9E10.2 | CDR-L1 | LASEDIYSDLA |
| 1258 | hBEW-9E10.2 | CDR-L2 | NANGLQN |
| 1259 | hBEW-9E10.2 | CDR-L3 | QQYNYFPGT |
| 1260 | hBEW-9E10.3 | VH | EVQLVQSGAEVKKPGSSVKVSCKASG YTFTNYGMYWVRQAPGQGLEWMGWID TETGRPTYADDFKGRFTFTADKSTST AYMELSSLRSEDTAVYYCARWSGDTT GIRGPWFAYWGQGTLVTVSS |
| 1261 | hBEW-9E10.3 | CDR-H1 | GYTFTNYGMY |
| 1262 | hBEW-9E10.3 | CDR-H2 | WIDTETGRPTYADDFKG |
| 1263 | hBEW-9E10.3 | CDR-H3 | WSGDTTGIRGPWFAY |
| 1264 | hBEW-9E10.3 | VL | DIRMTQSPSSLSASVGDRVTIECLAS EDIYSDLAWYQQKPGKSPKLLTYNAN GLQNGVPSRFSGSGSGTDYSLTISSL QPEDVATYFCQQYNYFPGTFGQGTKL EIK |
| 1265 | hBEW-9E10.3 | CDR-L1 | LASEDIYSDLA |
| 1266 | hBEW-9E10.3 | CDR-L2 | NANGLQN |
| 1267 | hBEW-9E10.3 | CDR-L3 | QQYNYFPGT |
| 1268 | hBEW-9E10.4 | VH | EIQLVQSGSELKKPGASVKVSCKASG YTFTNYGMYWVKQAPGQGLEYMGWID TETGRPTYADDFKGRFVFSLDTSVST AYLQISSLKAEDTAVYFCARWSGDTT GIRGPWFAYWGQGTLVTVSS |
| 1269 | hBEW-9E10.4 | CDR-H1 | GYTFTNYGMY |
| 1270 | hBEW-9E10.4 | CDR-H2 | WIDTETGRPTYADDFKG |
| 1271 | hBEW-9E10.4 | CDR-H3 | WSGDTTGIRGPWFAY |

TABLE 27-continued

VH and VL Amino Acid Sequences of Humanized Rat Anti-Human VEGF-A Monoclonal Antibodies (CDRs in bold)

| SEQ ID NO: | Clone | Protein Region | V Region 1234567890123456789012334567890 |
|---|---|---|---|
| 1272 | hBEW-9E10.4 | VL | DIRMTQSPSSLSASVGDRVTITCLASEDIYSDLAWYQQKPGKSPKLLTYNANGLQNGVPSRFSGSGSGTDYTLTISSLQPEDVATYFCQQYNYFPGTFGQGTKLEIK |
| 1273 | hBEW-9E10.4 | CDR-L1 | LASEDIYSDLA |
| 1274 | hBEW-9E10.4 | CDR-L2 | NANGLQN |
| 1275 | hBEW-9E10.4 | CDR-L3 | QQYNYFPGT |
| 1276 | hBEW-9E10.5 | VH | EIQLVQSGAEVKKPGSSVKVSCKASGYTFTNYGMYWVKQAPGQGLEYMGWIDTETGRPTYADDFKGRFTFTADKSTSTAYMELSSLRSEDTAVYFCARWSGDTTGIRGPWFAYWGQGTLVTVSS |
| 1277 | hBEW-9E10.5 | CDR-H1 | GYTFTNYGMY |
| 1278 | hBEW-9E10.5 | CDR-H2 | WIDTETGRPTYADDFKG |
| 1279 | hBEW-9E10.5 | CDR-H3 | WSGDTTGIRGPWFAY |
| 1280 | hBEW-9E10.5 | VL | DIRMTQSPSSLSASVGDRVTITCLASEDIYSDLAWYQQKPGKSPKLLTYNANGLQNGVPSRFSGSGSGTDYTLTISSLQPEDVATYFCQQYNYFPGTFGQGTKLEIK |
| 1281 | hBEW-9E10.5 | CDR-L1 | LASEDIYSDLA |
| 1282 | hBEW-9E10.5 | CDR-L2 | NANGLQN |
| 1283 | hBEW-9E10.5 | CDR-L3 | QQYNYFPGT |
| 1284 | hBEW-9E10.6 | VH | EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSS |
| 1285 | hBEW-9E10.6 | CDR-H1 | GYTFTNYGMY |
| 1286 | hBEW-9E10.6 | CDR-H2 | WIDTETGRPTYADDFKG |
| 1287 | hBEW-9E10.6 | CDR-H3 | WSGDTTGIRGPWFAY |
| 1288 | hBEW-9E10.6 | VL | DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIK |
| 1289 | hBEW-9E10.6 | CDR-L1 | LASEDIYSDLA |
| 1290 | hBEW-9E10.6 | CDR-L2 | NANGLQN |
| 1291 | hBEW-9E10.6 | CDR-L3 | QQYNYFPGT |
| 1292 | AB014 | VH | EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS |
| 1293 | AB014 | CDR-H1 | GYTFTNYGMN |
| 1294 | AB014 | CDR-H2 | WINTYTGEPTYAADFKR |

TABLE 27-continued

VH and VL Amino Acid Sequences of Humanized
Rat Anti-Human VEGF-A Monoclonal Antibodies
(CDRs in bold)

| SEQ ID NO: | Clone | Protein Region | V Region 12345678901234567890123456789 0 |
|---|---|---|---|
| 1295 | AB014 | CDR-H3 | YPHYYGSSHWYFDV |
| 1296 | AB014 VL | | DIQMTQSPSSLSASVGDRV TITCSASQDISNYLNWYQQ KPGKAPKVLIYFTSSLHSG VPSRFSGSGSGTDFTLTIS SLQPEDFATYYCQQYSTVP WTFGQGTKVEIK |
| 1297 | AB014 | CDR-L1 | SASQDISNYLN |
| 1298 | AB014 | CDR-L2 | FTSSLHS |
| 1299 | AB014 | CDR-L3 | QQYSTVPWT |

TABLE 28

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1300 | hBDI-1E1.1 VH | | EVQLVQSGAEVKKPGSSVKVSCKASGYTFTDYVMHW VRQAPGQGLEWMGTIIPLIDTTSYNQKFKGRVTITA DKSTSTAYMELSSLRSEDTAVYYCARTSPYYYSSYD VMDAWGQGTTVTVSS |
| 1301 | hBDI-1E1.1 | CDR-H1 | GYTFTDYVMH |
| 1302 | hBDI-1E1.1 | CDR-H2 | TIIPLIDTTSYNQKFKG |
| 1303 | hBDI-1E1.1 | CDR-H3 | TSPYYYSSYDVMDA |
| 1304 | hBDI-1E1.1 VL | | AIQLTQSPSSLSASVGDRVTITCKGSQNINNYLAWY QQKPGKAPKLLIYKTNNLQTGVPSRFSGSGSGTDFT LTISSLQPEDFATYYCYQYDNGYTFGQGTKLEIK |
| 1305 | hBDI-1E1.1 | CDR-L1 | KGSQNINNYLA |
| 1306 | hBDI-1E1.1 | CDR-L2 | KTNNLQT |
| 1307 | hBDI-1E1.1 | CDR-L3 | YQYDNGYT |
| 1308 | hBDI-1E1.10 VH | | EVQLVQSGAEVKKPGSSVKVSCKASGYTFTDYVMHW VRQAPGQGLEWIGTIIPLIDTTSYNQKFKGRVTITA DKSTSTAYMELSSLRSEDTAVYYCARTSPYYYSSYD VMDAWGQGTTVTVSS |
| 1309 | hBDI-1E1.10 | CDR-H1 | GYTFTDYVMH |
| 1310 | hBDI-1E1.10 | CDR-H2 | TIIPLIDTTSYNQKFKG |
| 1311 | hBDI-1E1.10 | CDR-H3 | TSPYYYSSYDVMDA |
| 1312 | hBDI-1E1.10 VL | | AIQLTQSPSSLSASVGDRVTITCKGSQNINNYLAWY QQKPGKAPKLLIYKTNNLQTGIPSRFSGSGSGTDYT LTISSLQPEDFATYYCYQYDNGYTFGQGTKLEIK |
| 1313 | hBDI-1E1.10 | CDR-L1 | KGSQNINNYLA |
| 1314 | hBDI-1E1.10 | CDR-L2 | KTNNLQT |
| 1315 | hBDI-1E1.10 | CDR-L3 | YQYDNGYT |
| 1316 | hBDI-1E1.11 VH | | EVQLVQSGAEVKKPGSSVKVSCKASGYTFTDYVMHW VRQAPGQGLEWIGTIIPLIDTTSYNQKFKGRVTITA DKSTSTAYMELSSLRSEDTAVYYCARTSPYYYSSYD VMDAWGQGTTVTVSS |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456 7890 |
|---|---|---|---|
| 1317 | hBDI-1E1.11 | CDR-H1 | GYTFTDYVMH |
| 1318 | hBDI-1E1.11 | CDR-H2 | TIIPLIDTTSYNQKFKG |
| 1319 | hBDI-1E1.11 | CDR-H3 | TSPYYYSSYDVMDA |
| 1320 | hBDI-1E1.11 | VL | EIVLTQSPATLSLSPGERATLSCKGSQNINNYLAWYQQKPGQAPRLLIYKTNNLQTGIPARFSGSGSGTDFTLTISSLEPEDFAVYYCYQYDNGYTFGQGTKLEIK |
| 1321 | hBDI-1E1.11 | CDR-L1 | KGSQNINNYLA |
| 1322 | hBDI-1E1.11 | CDR-L2 | KTNNLQT |
| 1323 | hBDI-1E1.11 | CDR-L3 | YQYDNGYT |
| 1324 | hBDI-1E1.12 | VH | EVQLVQSGAEVKKPGSSVKVSCKASGYTFTDYVMHWVRQAPGQGLEWIGTIIPLIDTTSYNQKFKGRVTITADKSTSTAYMELSSLRSEDTAVYYCARTSPYYYSSYDVMDAWGQGTTVTVSS |
| 1325 | hBDI-1E1.12 | CDR-H1 | GYTFTDYVMH |
| 1326 | hBDI-1E1.12 | CDR-H2 | TIIPLIDTTSYNQKFKG |
| 1327 | hBDI-1E1.12 | CDR-H3 | TSPYYYSSYDVMDA |
| 1328 | hBDI-1E1.12 | VL | EIVLTQSPATLSLSPGERATLSCKGSQNINNYLAWYQQKPGQAPRLLIYKTNNLQTGIPARFSGSGSGTDYTLTISSLEPEDFATYYCYQYDNGYTFGQGTKLEIK |
| 1329 | hBDI-1E1.12 | CDR-L1 | KGSQNINNYLA |
| 1330 | hBDI-1E1.12 | CDR-L2 | KTNNLQT |
| 1331 | hBDI-1E1.12 | CDR-L3 | YQYDNGYT |
| 1332 | hBDI-1E1.2 | VH | EVQLVQSGAEVKKPGSSVKVSCKASGYTFTDYVMHWVRQAPGQGLEWMGTIIPLIDTTSYNQKFKGRVTITADKSTSTAYMELSSLRSEDTAVYYCARTSPYYYSSYDVMDAWGQGTTVTVSS |
| 1333 | hBDI-1E1.2 | CDR-H1 | GYTFTDYVMH |
| 1334 | hBDI-1E1.2 | CDR-H2 | TIIPLIDTTSYNQKFKG |
| 1335 | hBDI-1E1.2 | CDR-H3 | TSPYYYSSYDVMDA |
| 1336 | hBDI-1E1.2 | VL | AIQLTQSPSSLSASVGDRVTITCKGSQNINNYLAWYQQKPGKAPKLLIYKTNNLQTGIPSRFSGSGSGTDYTLTISSLQPEDFATYYCYQYDNGYTFGQGTKLEIK |
| 1337 | hBDI-1E1.2 | CDR-L1 | KGSQNINNYLA |
| 1338 | hBDI-1E1.2 | CDR-L2 | KTNNLQT |
| 1339 | hBDI-1E1.2 | CDR-L3 | YQYDNGYT |
| 1340 | hBDI-1E1.3 | VH | EVQLVQSGAEVKKPGSSVKVSCKASGYTFTDYVMHWVRQAPGQGLEWMGTIIPLIDTTSYNQKFKGRVTITADKSTSTAYMELSSLRSEDTAVYYCARTSPYYYSSYDVMDAWGQGTTVTVSS |
| 1341 | hBDI-1E1.3 | CDR-H1 | GYTFTDYVMH |
| 1342 | hBDI-1E1.3 | CDR-H2 | TIIPLIDTTSYNQKFKG |
| 1343 | hBDI-1E1.3 | CDR-H3 | TSPYYYSSYDVMDA |
| 1344 | hBDI-1E1.3 | VL | EIVLTQSPATLSLSPGERATLSCKGSQNINNYLAWYQQKPGQAPRLLIYKTNNLQTGIPARFSGSGSGTDFTLTISSLEPEDFAVYYCYQYDNGYTFGQGTKLEIK |
| 1345 | hBDI-1E1.3 | CDR-L1 | KGSQNINNYLA |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1346 | hBDI-1E1.3 | CDR-L2 | KTNNLQT |
| 1347 | hBDI-1E1.3 | CDR-L3 | YQYDNGYT |
| 1348 | hBDI-1E1.4 | VH | EVQLVQSGAEVKKPGSSVKVSCKASGYTFTDYVMHW VRQAPGQGLEWMGTIIPLIDTTSYNQKFKGRVTITA DKSTSTAYMELSSLRSEDTAVYYCARTSPYYYSSYD VMDAWGQGTTVTVSS |
| 1349 | hBDI-1E1.4 | CDR-H1 | GYTFTDYVMH |
| 1350 | hBDI-1E1.4 | CDR-H2 | TIIPLIDTTSYNQKFKG |
| 1351 | hBDI-1E1.4 | CDR-H3 | TSPYYYSSYDVMDA |
| 1352 | hBDI-1E1.4 | VL | EIVLTQSPATLSLSPGERATLSCKGSQNINNYLAWY QQKPGQAPRLLIYKTNNLQTGIPARFSGSGSGTDYT LTISSLEPEDFATYYCYQYDNGYTFGQGTKLEIK |
| 1353 | hBDI-1E1.4 | CDR-L1 | KGSQNINNYLA |
| 1354 | hBDI-1E1.4 | CDR-L2 | KTNNLQT |
| 1355 | hBDI-1E1.4 | CDR-L3 | YQYDNGYT |
| 1356 | hBDI-1E1.5 | VH | EVQLVQSGAEVKKPGSSVKVSCKASGYTFTDYVMHW VRQAPGQGLEWIGTIIPLIDTTSYNQKFKGRATLTA DKSTNTAYMELSSLRSEDTAVYYCARTSPYYYSSYD VMDAWGQGTTVTVSS |
| 1357 | hBDI-1E1.5 | CDR-H1 | GYTFTDYVMH |
| 1358 | hBDI-1E1.5 | CDR-H2 | TIIPLIDTTSYNQKFKG |
| 1359 | hBDI-1E1.5 | CDR-H3 | TSPYYYSSYDVMDA |
| 1360 | hBDI-1E1.5 | VL | AIQLTQSPSSLSASVGDRVTITCKGSQNINNYLAWY QQKPGKAPKLLIYKTNNLQTGVPSRFSGSGSGTDFT LTISSLQPEDFATYYCYQYDNGYTFGQGTKLEIK |
| 1361 | hBDI-1E1.5 | CDR-L1 | KGSQNINNYLA |
| 1362 | hBDI-1E1.5 | CDR-L2 | KTNNLQT |
| 1363 | hBDI-1E1.5 | CDR-L3 | YQYDNGYT |
| 1364 | hBDI-1E1.6 | VH | EVQLVQSGAEVKKPGSSVKVSCKASGYTFTDYVMHW VRQAPGQGLEWIGTIIPLIDTTSYNQKFKGRATLTA DKSTNTAYMELSSLRSEDTAVYYCARTSPYYYSSYD VMDAWGQGTTVTVSS |
| 1365 | hBDI-1E1.6 | CDR-H1 | GYTFTDYVMH |
| 1366 | hBDI-1E1.6 | CDR-H2 | TIIPLIDTTSYNQKFKG |
| 1367 | hBDI-1E1.6 | CDR-H3 | TSPYYYSSYDVMDA |
| 1368 | hBDI-1E1.6 | VL | AIQLTQSPSSLSASVGDRVTITCKGSQNINNYLAWY QQKPGKAPKLLIYKTNNLQTGIPSRFSGSGSGTDYT LTISSLQPEDFATYYCYQYDNGYTFGQGTKLEIK |
| 1369 | hBDI-1E1.6 | CDR-L1 | KGSQNINNYLA |
| 1370 | hBDI-1E1.6 | CDR-L2 | KTNNLQT |
| 1371 | hBDI-1E1.6 | CDR-L3 | YQYDNGYT |
| 1372 | hBDI-1E1.7 | VH | EVQLVQSGAEVKKPGSSVKVSCKASGYTFTDYVMHW VRQAPGQGLEWIGTIIPLIDTTSYNQKFKGRATLTA DKSTNTAYMELSSLRSEDTAVYYCARTSPYYYSSYD VMDAWGQGTTVTVSS |
| 1373 | hBDI-1E1.7 | CDR-H1 | GYTFTDYVMH |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 |
|---|---|---|---|
| 1374 | hBDI-1E1.7 | CDR-H2 | TIIPLIDTTSYNQKFKG |
| 1375 | hBDI-1E1.7 | CDR-H3 | TSPYYYSSYDVMDA |
| 1376 | hBDI-1E1.7 | VL | EIVLTQSPATLSLSPGERATLSCKGSQNINNYLAWYQQKPGQAPRLLIYKTNNLQTGIPARFSGSGSGTDFTLTISSLEPEDFAVYYCYQYDNGYTFGQGTKLEIK |
| 1377 | hBDI-1E1.7 | CDR-L1 | KGSQNINNYLA |
| 1378 | hBDI-1E1.7 | CDR-L2 | KTNNLQT |
| 1379 | hBDI-1E1.7 | CDR-L3 | YQYDNGYT |
| 1380 | hBDI-1E1.8 | VH | EVQLVQSGAEVKKPGSSVKVSCKASGYTFTDYVMHWVRQAPGQGLEWIGTIIPLIDTTSYNQKFKGRATLTADKSTNTAYMELSSLRSEDTAVYYCARTSPYYYSSYDVMDAWGQGTTVTVSS |
| 1381 | hBDI-1E1.8 | CDR-H1 | GYTFTDYVMH |
| 1382 | hBDI-1E1.8 | CDR-H2 | TIIPLIDTTSYNQKFKG |
| 1383 | hBDI-1E1.8 | CDR-H3 | TSPYYYSSYDVMDA |
| 1384 | hBDI-1E1.8 | VL | EIVLTQSPATLSLSPGERATLSCKGSQNINNYLAWYQQKPGQAPRLLIYKTNNLQTGIPARFSGSGSGTDYTLTISSLEPEDFATYYCYQYDNGYTFGQGTKLEIK |
| 1385 | hBDI-1E1.8 | CDR-L1 | KGSQNINNYLA |
| 1386 | hBDI-1E1.8 | CDR-L2 | KTNNLQT |
| 1387 | hBDI-1E1.8 | CDR-L3 | YQYDNGYT |
| 1388 | hBDI-1E1.9 | VH | EVQLVQSGAEVKKPGSSVKVSCKASGYTFTDYVMHWVRQAPGQGLEWIGTIIPLIDTTSYNQKFKGRVTITADKSTSTAYMELSSLRSEDTAVYYCARTSPYYYSSYDVMDAWGQGTTVTVSS |
| 1389 | hBDI-1E1.9 | CDR-H1 | GYTFTDYVMH |
| 1390 | hBDI-1E1.9 | CDR-H2 | TIIPLIDTTSYNQKFKG |
| 1391 | hBDI-1E1.9 | CDR-H3 | TSPYYYSSYDVMDA |
| 1392 | hBDI-1E1.9 | VL | AIQLTQSPSSLSASVGDRVTITCKGSQNINNYLAWYQQKPGKAPKLLIYKTNNLQTGVPSRFSGSGSGTDFTLTISSLQPEDFATYYCYQYDNGYTFGQGTKLEIK |
| 1393 | hBDI-1E1.9 | CDR-L1 | KGSQNINNYLA |
| 1394 | hBDI-1E1.9 | CDR-L2 | KTNNLQT |
| 1395 | hBDI-1E1.9 | CDR-L3 | YQYDNGYT |
| 1396 | hBDI-5H1.1 | VH | EVTLRESGPALVKPTQTLTLTCTFSGFSLSTFGMGVGWIRQPPGKALEWLANIWWDDDKYYNPSLKNRLTISKDTSKNQVVLTMTNMDPVDTATYYCARISTGISSYYVMDAWGQGTTVTVSS |
| 1397 | hBDI-5H1.1 | CDR-H1 | GFSLSTFGMGVG |
| 1398 | hBDI-5H1.1 | CDR-H2 | NIWWDDDKYYNPSLKN |
| 1399 | hBDI-5H1.1 | CDR-H3 | ISTGISSYYVMDA |
| 1400 | hBDI-5H1.1 | VL | NFMLTQPHSVSESPGKTVTISCERSSGDIGDTYVSWYQQRPGSSPTTVIYGNDQRPSGVPDRFSGSIDSSSNSASLTISGLKTEDEADYYCQSYDSDIDIVFGGGTKLTVL |
| 1401 | hBDI-5H1.1 | CDR-L1 | ERSSGDIGDTYVS |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1402 | hBDI-5H1.1 | CDR-L2 | GNDQRPS |
| 1403 | hBDI-5H1.1 | CDR-L3 | QSYDSDIDIV |
| 1404 | hBDI-5H1.10 | VH | EVTLRESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1405 | hBDI-5H1.10 | CDR-H1 | GFSLSTFGMGVG |
| 1406 | hBDI-5H1.10 | CDR-H2 | NIWWDDDKYYNPSLKN |
| 1407 | hBDI-5H1.10 | CDR-H3 | ISTGISSYYVMDA |
| 1408 | hBDI-5H1.10 | VL | DFQLTQSPSSLSASVGDRVTITCERSSGDIGDTYVS WYQQKPGKAPKNVIYGNDQRPSGVPSRFSGSGSGNS ATLTISSLQPEDFATYFCQSYDSDIDIVFGQGTKVE IK |
| 1409 | hBDI-5H1.10 | CDR-L1 | ERSSGDIGDTYVS |
| 1410 | hBDI-5H1.10 | CDR-L2 | GNDQRPS |
| 1411 | hBDI-5H1.10 | CDR-L3 | QSYDSDIDIV |
| 1412 | hBDI-5H1.11 | VH | EVQLVESGGGLVQPGGSLRLSCAFSGFSLSTFGMGV GWIRQAPGKGLEWLANIWWDDDKYYNPSLKNRLTIS KDTSKNQAYLQINSLRAEDTAVYYCARISTGISSYY VMDAWGQGTLVTVSS |
| 1413 | hBDI-5H1.11 | CDR-H1 | GFSLSTFGMGVG |
| 1414 | hBDI-5H1.11 | CDR-H2 | NIWWDDDKYYNPSLKN |
| 1415 | hBDI-5H1.11 | CDR-H3 | ISTGISSYYVMDA |
| 1416 | hBDI-5H1.11 | VL | DFVLTQSPDSLAVSLGERATINCERSSGDIGDTYVS WYQQKPGQPPKNVIYGNDQRPSGVPDRFSGSGSGNS ATLTISSLQAEDVAVYFCQSYDSDIDIVFGGGTKVE IK |
| 1417 | hBDI-5H1.11 | CDR-L1 | ERSSGDIGDTYVS |
| 1418 | hBDI-5H1.11 | CDR-L2 | GNDQRPS |
| 1419 | hBDI-5H1.11 | CDR-L3 | QSYDSDIDIV |
| 1420 | hBDI-5H1.12 | VH | EVQLVESGGGLVQPGGSLRLSCAFSGFSLSTFGMGV GWIRQAPGKGLEWLANIWWDDDKYYNPSLKNRLTIS KDTSKNQAYLQINSLRAEDTAVYYCARISTGISSYY VMDAWGQGTLVTVSS |
| 1421 | hBDI-5H1.12 | CDR-H1 | GFSLSTFGMGVG |
| 1422 | hBDI-5H1.12 | CDR-H2 | NIWWDDDKYYNPSLKN |
| 1423 | hBDI-5H1.12 | CDR-H3 | ISTGISSYYVMDA |
| 1424 | hBDI-5H1.12 | VL | DFQLTQSPSSLSASVGDRVTITCERSSGDIGDTYVS WYQQKPGKAPKNVIYGNDQRPSGVPSRFSGSGSGNS ATLTISSLQPEDFATYFCQSYDSDIDIVFGQGTKVE IK |
| 1425 | hBDI-5H1.12 | CDR-L1 | ERSSGDIGDTYVS |
| 1426 | hBDI-5H1.12 | CDR-L2 | GNDQRPS |
| 1427 | hBDI-5H1.12 | CDR-L3 | QSYDSDIDIV |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 |
|---|---|---|---|
| 1428 | hBDI-5H1.13 | VH | EVTLKESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1429 | hBDI-5H1.13 | CDR-H1 | GFSLSTFGMGVG |
| 1430 | hBDI-5H1.13 | CDR-H2 | NIWWDDDKYYNPSLKN |
| 1431 | hBDI-5H1.13 | CDR-H3 | ISTGISSYYVMDA |
| 1432 | hBDI-5H1.13 | VL | DFQLTQSPSSLSASVGDRVTITCERSSGDIGDTYVS WYQQKPGKAPKNVIYGNDQRPSGVPSRFSGSGSGNS ATLTISSLQPEDFATYFCQSYDSDIDIVFGQGTKVE IK |
| 1433 | hBDI-5H1.13 | CDR-L1 | ERSSGDIGDTYVS |
| 1434 | hBDI-5H1.13 | CDR-L2 | GNDQRPS |
| 1435 | hBDI-5H1.13 | CDR-L3 | QSYDSDIDIV |
| 1436 | hBDI-5H1.16 | VH | EVTLKESGPALVKPTQTLTLTCTFSGFSLSTFGMGV GWIRQPPGKGLEWLANIWWDDDKYYNPSLKNRLTIS KDTSNSQAVLTITNMDPVDTATYYCARISTGISSYY VMDAWGQGTTVTVSS |
| 1437 | hBDI-5H1.16 | CDR-H1 | GFSLSTFGMGVG |
| 1438 | hBDI-5H1.16 | CDR-H2 | NIWWDDDKYYNPSLKN |
| 1439 | hBDI-5H1.16 | CDR-H3 | ISTGISSYYVMDA |
| 1440 | hBDI-5H1.16 | VL | EFVLTQSPGTLSLSPGERATLSCERSSGDIGDTYVS WYQQKPGQPPRNVIYGNDQRPSGVPDRFSGSGSGTD FTLTISRLEPEDFAVYFCQSYDSDIDIVFGGGTKVE IK |
| 1441 | hBDI-5H1.16 | CDR-L1 | ERSSGDIGDTYVS |
| 1442 | hBDI-5H1.16 | CDR-L2 | GNDQRPS |
| 1443 | hBDI-5H1.16 | CDR-L3 | QSYDSDIDIV |
| 1444 | hBDI-5H1.17 | VH | EVTLKESGPALVKPTQTLTLTCTFSGFSLSTFGMGV GWIRQPPGKGLEWLANIWWDDDKYYNPSLKNRLTIS KDTSNSQAVLTITNMDPVDTATYYCARISTGISSYY VMDAWGQGTTVTVSS |
| 1445 | hBDI-5H1.17 | CDR-H1 | GFSLSTFGMGVG |
| 1446 | hBDI-5H1.17 | CDR-H2 | NIWWDDDKYYNPSLKN |
| 1447 | hBDI-5H1.17 | CDR-H3 | ISTGISSYYVMDA |
| 1448 | hBDI-5H1.17 | VL | EFVLTQSPGTLSLSPGERATLSCERSSGDIGDSYVS WYQQKPGQAPRLVIYADDQRPSGIPDRFSGSGSGTD FTLTISRLEPEDFAVYYCQSYDINIDIVFGGGTKVE IK |
| 1449 | hBDI-5H1.17 | CDR-L1 | ERSSGDIGDSYVS |
| 1450 | hBDI-5H1.17 | CDR-L2 | ADDQRPS |
| 1451 | hBDI-5H1.17 | CDR-L3 | QSYDINIDIV |
| 1452 | hBDI-5H1.2 | VH | EVTLRESGPALVKPTQTLTLTCTFSGFSLSTFGMGV GWIRQPPGKALEWLANIWWDDDKYYNPSLKNRLTIS KDTSKNQVVLTMTNMDPVDTATYYCARISTGISSYY VMDAWGQGTTVTVSS |
| 1453 | hBDI-5H1.2 | CDR-H1 | GFSLSTFGMGVG |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1454 | hBDI-5H1.2 | CDR-H2 | NIWWDDDKYYNPSLKN |
| 1455 | hBDI-5H1.2 | CDR-H3 | ISTGISSYYVMDA |
| 1456 | hBDI-5H1.2 | VL | NFMLTQPHSVSESPGKTVTISCERSSGDIGDTYVSW YQQRPGSPPTNVIYGNDQRPSGVPDRFSGSIDSSSN SASLTISGLKTEDEADYFCQSYDSDIDIVFGGGTKL TVL |
| 1457 | hBDI-5H1.2 | CDR-L1 | ERSSGDIGDTYVS |
| 1458 | hBDI-5H1.2 | CDR-L2 | GNDQRPS |
| 1459 | hBDI-5H1.2 | CDR-L3 | QSYDSDIDIV |
| 1460 | hBDI-5H1.3 | VH | EVTLRESGPALVKPTQTLTLTCTFSGFSLSTFGMGV GWIRQPPGKALEWLANIWWDDDKYYNPSLKNRLTIS KDTSKNQVVLTMTNMDPVDTATYYCARISTGISSYY VMDAWGQGTTVTVSS |
| 1461 | hBDI-5H1.3 | CDR-H1 | GFSLSTFGMGVG |
| 1462 | hBDI-5H1.3 | CDR-H2 | NIWWDDDKYYNPSLKN |
| 1463 | hBDI-5H1.3 | CDR-H3 | ISTGISSYYVMDA |
| 1464 | hBDI-5H1.3 | VL | EIVLTQSPGTLSLSPGERATLSCERSSGDIGDTYVS WYQQKPGQAPRLLIYGNDQRPSGIPDRFSGSGSGTD FTLTISRLEPEDFAVYYCQSYDSDIDIVFGGGTKVE IK |
| 1465 | hBDI-5H1.3 | CDR-L1 | ERSSGDIGDTYVS |
| 1466 | hBDI-5H1.3 | CDR-L2 | GNDQRPS |
| 1467 | hBDI-5H1.3 | CDR-L3 | QSYDSDIDIV |
| 1468 | hBDI-5H1.4 | VH | EVTLRESGPALVKPTQTLTLTCTFSGFSLSTFGMGV GWIRQPPGKALEWLANIWWDDDKYYNPSLKNRLTIS KDTSKNQVVLTMTNMDPVDTATYYCARISTGISSYY VMDAWGQGTTVTVSS |
| 1469 | hBDI-5H1.4 | CDR-H1 | GFSLSTFGMGVG |
| 1470 | hBDI-5H1.4 | CDR-H2 | NIWWDDDKYYNPSLKN |
| 1471 | hBDI-5H1.4 | CDR-H3 | ISTGISSYYVMDA |
| 1472 | hBDI-5H1.4 | VL | EFVLTQSPGTLSLSPGERATLSCERSSGDIGDTYVS WYQQKPGQAPRLVIYGNDQRPSGIPDRFSGSGSGTD FTLTISRLEPEDFAVYYCQSYDSDIDIVFGGGTKVE IK |
| 1473 | hBDI-5H1.4 | CDR-L1 | ERSSGDIGDTYVS |
| 1474 | hBDI-5H1.4 | CDR-L2 | GNDQRPS |
| 1475 | hBDI-5H1.4 | CDR-L3 | QSYDSDIDIV |
| 1476 | hBDI-5H1.5 | VH | EVTLKESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1477 | hBDI-5H1.5 | CDR-H1 | GFSLSTFGMGVG |
| 1478 | hBDI-5H1.5 | CDR-H2 | NIWWDDDKYYNPSLKN |
| 1479 | hBDI-5H1.5 | CDR-H3 | ISTGISSYYVMDA |
| 1480 | hBDI-5H1.5 | VL | NFMLTQPHSVSESPGKTVTISCERSSGDIGDTYVSW YQQRPGSSPTTVIYGNDQRPSGVPDRFSGSIDSSSN SASLTISGLKTEDEADYYCQSYDSDIDIVFGGGTKL TVL |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1481 | hBDI-5H1.5 | CDR-L1 | ERSSGDIGDTYVS |
| 1482 | hBDI-5H1.5 | CDR-L2 | GNDQRPS |
| 1483 | hBDI-5H1.5 | CDR-L3 | QSYDSDIDIV |
| 1484 | hBDI-5H1.6 | VH | EVTLKESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1485 | hBDI-5H1.6 | CDR-H1 | GFSLSTFGMGVG |
| 1486 | hBDI-5H1.6 | CDR-H2 | NIWWDDDKYYNPSLKN |
| 1487 | hBDI-5H1.6 | CDR-H3 | ISTGISSYYVMDA |
| 1488 | hBDI-5H1.6 | VL | NFMLTQPHSVSESPGKTVTISCERSSGDIGDTYVSW YQQRPGSPPTNVIYGNDQRPSGVPDRFSGSIDSSSN SASLTISGLKTEDEADYFCQSYDSDIDIVFGGGTKL TVL |
| 1489 | hBDI-5H1.6 | CDR-L1 | ERSSGDIGDTYVS |
| 1490 | hBDI-5H1.6 | CDR-L2 | GNDQRPS |
| 1491 | hBDI-5H1.6 | CDR-L3 | QSYDSDIDIV |
| 1492 | hBDI-5H1.7 | VH | EVTLKESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1493 | hBDI-5H1.7 | CDR-H1 | GFSLSTFGMGVG |
| 1494 | hBDI-5H1.7 | CDR-H2 | NIWWDDDKYYNPSLKN |
| 1495 | hBDI-5H1.7 | CDR-H3 | ISTGISSYYVMDA |
| 1496 | hBDI-5H1.7 | VL | EIVLTQSPGTLSLSPGERATLSCERSSGDIGDTYVS WYQQKPGQAPRLLIYGNDQRPSGIPDRFSGSGSGTD FTLTISRLEPEDFAVYYCQSYDSDIDIVFGGGTKVE IK |
| 1497 | hBDI-5H1.7 | CDR-L1 | ERSSGDIGDTYVS |
| 1498 | hBDI-5H1.7 | CDR-L2 | GNDQRPS |
| 1499 | hBDI-5H1.7 | CDR-L3 | QSYDSDIDIV |
| 1500 | hBDI-5H1.8 | VH | EVTLKESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1501 | hBDI-5H1.8 | CDR-H1 | GFSLSTFGMGVG |
| 1502 | hBDI-5H1.8 | CDR-H2 | NIWWDDDKYYNPSLKN |
| 1503 | hBDI-5H1.8 | CDR-H3 | ISTGISSYYVMDA |
| 1504 | hBDI-5H1.8 | VL | EFVLTQSPGTLSLSPGERATLSCERSSGDIGDTYVS WYQQKPGQAPRLVIYGNDQRPSGIPDRFSGSGSGTD FTLTISRLEPEDFAVYYCQSYDSDIDIVFGGGTKVE IK |
| 1505 | hBDI-5H1.8 | CDR-L1 | ERSSGDIGDTYVS |
| 1506 | hBDI-5H1.8 | CDR-L2 | GNDQRPS |
| 1507 | hBDI-5H1.8 | CDR-L3 | QSYDSDIDIV |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1508 | hBDI-5H1.9 | VH | EVTLRESGPALVKPTQTLTLTCTFSGFSLSTFGMGV GWIRQPPGKALEWLANIWWDDDKYYNPSLKNRLTIS KDTSKNQAVLTITNMDPVDTATYYCARISTGISSYY VMDAWGQGTTVTVSS |
| 1509 | hBDI-5H1.9 | CDR-H1 | GFSLSTFGMGVG |
| 1510 | hBDI-5H1.9 | CDR-H2 | NIWWDDDKYYNPSLKN |
| 1511 | hBDI-5H1.9 | CDR-H3 | ISTGISSYYVMDA |
| 1512 | hBDI-5H1.9 | VL | DFVLTQSPDSLAVSLGERATINCERSSGDIGDTYVS WYQQKPGQPPKNVIYGNDQRPSGVPDRFSGSGSGNS ATLTISSLQAEDVAVYFCQSYDSDIDIVFGGGTKVE IK |
| 1513 | hBDI-5H1.9 | CDR-L1 | ERSSGDIGDTYVS |
| 1514 | hBDI-5H1.9 | CDR-L2 | GNDQRPS |
| 1515 | hBDI-5H1.9 | CDR-L3 | QSYDSDIDIV |
| 1516 | hBDI-9E8.1 | VH | EVTLRESGPALVKPTQTLTLTCTFSGFSLSTYGMGV GWIRQPPGKALEWLANIWWDDDKYYNPSLKNRLTIS KDTSKNQVVLTMTNMDPVDTATYYCARIESIGTTYS FDYWGQGTMVTVSS |
| 1517 | hBDI-9E8.1 | CDR-H1 | GFSLSTYGMGVG |
| 1518 | hBDI-9E8.1 | CDR-H2 | NIWWDDDKYYNPSLKN |
| 1519 | hBDI-9E8.1 | CDR-H3 | IESIGTTYSFDY |
| 1520 | hBDI-9E8.1 | VL | NPMLTQPHSVSESPGKTVTISCERSSGDIGDSYVSW YQQRPGSSPTTVIYADDQRPSGVPDRFSGSIDSSSN SASLTISGLKTEDEADYYCQSYDINIDIVFGGGTKL TVL |
| 1521 | hBDI-9E8.1 | CDR-L1 | ERSSGDIGDSYVS |
| 1522 | hBDI-9E8.1 | CDR-L2 | ADDQRPS |
| 1523 | hBDI-9E8.1 | CDR-L3 | QSYDINIDIV |
| 1524 | hBDI-9E8.10 | VH | EVTLRESGPALVKPTQTLTLTCTFSGFSLSTYGMGV GWIRQPPGKALEWLANIWWDDDKYYNPSLKNRLTIS KDTSKNQAVLTITNMDPVDTATYYCARIESIGTTYS FDYWGQGTTVTVSS |
| 1525 | hBDI-9E8.10 | CDR-H1 | GFSLSTYGMGVG |
| 1526 | hBDI-9E8.10 | CDR-H2 | NIWWDDDKYYNPSLKN |
| 1527 | hBDI-9E8.10 | CDR-H3 | IESIGTTYSFDY |
| 1528 | hBDI-9E8.10 | VL | DFQLTQSPSSLSASVGDRVTITCERSSGDIGDSYVS WYQQKPGKAPKNVIYADDQRPSGVPSRFSGSGSGNS ASLTISSLQPEDFATYYCQSYDINIDIVFGQGTKVE IK |
| 1529 | hBDI-9E8.10 | CDR-L1 | ERSSGDIGDSYVS |
| 1530 | hBDI-9E8.10 | CDR-L2 | ADDQRPS |
| 1531 | hBDI-9E8.10 | CDR-L3 | QSYDINIDIV |
| 1532 | hBDI-9E8.11 | VH | EVQLVESGGGLVQPGGSLRLSCAFSGFSLSTYGMGV GWIRQAPGKGLEWLANIWWDDDKYYNPSLKNRLTIS KDTSKNQAYLQINSLRAEDTAVYYCARIESIGTTYS FDYWGQGTLVTVSS |
| 1533 | hBDI-9E8.11 | CDR-H1 | GFSLSTYGMGVG |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1534 | hBDI-9E8.11 | CDR-H2 | NIWWDDDKYYNPSLKN |
| 1535 | hBDI-9E8.11 | CDR-H3 | IESIGTTYSFDY |
| 1536 | hBDI-9E8.11 | VL | DFVLTQSPDSLAVSLGERATINCERSSGDIGDSYVSWYQQKPGQPPKNVIYADDQRPSGVPDRFSGSGSGNSASLTISSLQAEDVAVYFCQSYDINIDIVFGGGTKVEIK |
| 1537 | hBDI-9E8.11 | CDR-L1 | ERSSGDIGDSYVS |
| 1538 | hBDI-9E8.11 | CDR-L2 | ADDQRPS |
| 1539 | hBDI-9E8.11 | CDR-L3 | QSYDINIDIV |
| 1540 | hBDI-9E8.12 | VH | EVQLVESGGGLVQPGGSLRLSCAFSGFSLSTYGMGV GWIRQAPGKGLEWLANIWWDDDKYYNPSLKNRLTISKDTSKNQAYLQINSLRAEDTAVYYCARIESIGTTYSFDYWGQGTLVTVSS |
| 1541 | hBDI-9E8.12 | CDR-H1 | GFSLSTYGMGVG |
| 1542 | hBDI-9E8.12 | CDR-H2 | NIWWDDDKYYNPSLKN |
| 1543 | hBDI-9E8.12 | CDR-H3 | IESIGTTYSFDY |
| 1544 | hBDI-9E8.12 | VL | DFQLTQSPSSLSASVGDRVTITCERSSGDIGDSYVSWYQQKPGKAPKNVIYADDQRPSGVPSRFSGSGSGNSASLTISSLQPEDFATYYCQSYDINIDIVFGQGTKVEIK |
| 1545 | hBDI-9E8.12 | CDR-L1 | ERSSGDIGDSYVS |
| 1546 | hBDI-9E8.12 | CDR-L2 | ADDQRPS |
| 1547 | hBDI-9E8.12 | CDR-L3 | QSYDINIDIV |
| 1548 | hBDI-9E8.13 | VH | EVTLRESGPALVKPTQTLTLTCTFSGFSLSTYGMGV GWIRQPPGKGLEWLANIWWDDDKYYNPSLKNRLTISKDTSKNQAVLTITNMDPVDTATYYCARIESIGTTYSFDYWGQGTMVTVSS |
| 1549 | hBDI-9E8.13 | CDR-H1 | GFSLSTYGMGVG |
| 1550 | hBDI-9E8.13 | CDR-H2 | NIWWDDDKYYNPSLKN |
| 1551 | hBDI-9E8.13 | CDR-H3 | IESIGTTYSFDY |
| 1552 | hBDI-9E8.13 | VL | DFQLTQSPSSLSASVGDRVTITCERSSGDIGDSYVSWYQQKPGKAPKNVIYADDQRPSGVPSRFSGSGSGNSASLTISSLQPEDFATYYCQSYDINIDIVFGQGTKVEIK |
| 1553 | hBDI-9E8.13 | CDR-L1 | ERSSGDIGDSYVS |
| 1554 | hBDI-9E8.13 | CDR-L2 | ADDQRPS |
| 1555 | hBDI-9E8.13 | CDR-L3 | QSYDINIDIV |
| 1556 | hBDI-9E8.2 | VH | EVTLRESGPALVKPTQTLTLTCTFSGFSLSTYGMGV GWIRQPPGKALEWLANIWWDDDKYYNPSLKNRLTISKDTSKNQVVLTMTNMDPVDTATYYCARIESIGTTYSFDYWGQGTMVTVSS |
| 1557 | hBDI-9E8.2 | CDR-H1 | GFSLSTYGMGVG |
| 1558 | hBDI-9E8.2 | CDR-H2 | NIWWDDDKYYNPSLKN |
| 1559 | hBDI-9E8.2 | CDR-H3 | IESIGTTYSFDY |
| 1560 | hBDI-9E8.2 | VL | NFMLTQPHSVSESPGKTVTISCERSSGDIGDSYVSWYQQRPGSPPTNVIYADDQRPSGVPDRFSGSIDSSSNSASLTISGLKTEDEADYFCQSYDINIDIVFGGGTKLTVL |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1561 | hBDI-9E8.2 | CDR-L1 | ERSSGDIGDSYVS |
| 1562 | hBDI-9E8.2 | CDR-L2 | ADDQRPS |
| 1563 | hBDI-9E8.2 | CDR-L3 | QSYDINIDIV |
| 1564 | hBDI-9E8.3 | VH | EVTLRESGPALVKPTQTLTLTCTFSGFSLSTYGMGV GWIRQPPGKALEWLANIWWDDDKYYNPSLKNRLTIS KDTSKNQVVLTMTNMDPVDTATYYCARIESIGTTYS FDYWGQGTMVTVSS |
| 1565 | hBDI-9E8.3 | CDR-H1 | GFSLSTYGMGVG |
| 1566 | hBDI-9E8.3 | CDR-H2 | NIWWDDDKYYNPSLKN |
| 1567 | hBDI-9E8.3 | CDR-H3 | IESIGTTYSFDY |
| 1568 | hBDI-9E8.3 | VL | EIVLTQSPGTLSLSPGERATLSCERSSGDIGDSYVS WYQQKPGQAPRLLIYADDQRPSGIPDRFSGSGSGTD FTLTISRLEPEDFAVYYCQSYDINIDIVFGGGTKVE IK |
| 1569 | hBDI-9E8.3 | CDR-L1 | ERSSGDIGDSYVS |
| 1570 | hBDI-9E8.3 | CDR-L2 | ADDQRPS |
| 1571 | hBDI-9E8.3 | CDR-L3 | QSYDINIDIV |
| 1572 | hBDI-9E8.4 | VH | EVTLRESGPALVKPTQTLTLTCTFSGFSLSTYGMGV GWIRQPPGKALEWLANIWWDDDKYYNPSLKNRLTIS KDTSKNQVVLTMTNMDPVDTATYYCARIESIGTTYS FDYWGQGTMVTVSS |
| 1573 | hBDI-9E8.4 | CDR-H1 | GFSLSTYGMGVG |
| 1574 | hBDI-9E8.4 | CDR-H2 | NIWWDDDKYYNPSLKN |
| 1575 | hBDI-9E8.4 | CDR-H3 | IESIGTTYSFDY |
| 1576 | hBDI-9E8.4 | VL | EFVLTQSPGTLSLSPGERATLSCERSSGDIGDSYVS WYQQKPGQAPRLVIYADDQRPSGIPDRFSGSGSGTD FTLTISRLEPEDFAVYYCQSYDINIDIVFGGGTKVE IK |
| 1577 | hBDI-9E8.4 | CDR-L1 | ERSSGDIGDSYVS |
| 1578 | hBDI-9E8.4 | CDR-L2 | ADDQRPS |
| 1579 | hBDI-9E8.4 | CDR-L3 | QSYDINIDIV |
| 1580 | hBDI-9E8.5 | VH | EVTLRESGPALVKPTQTLTLTCTFSGFSLSTYGMGV GWIRQPPGKGLEWLANIWWDDDKYYNPSLKNRLTIS KDTSKNQAVLTITNMDPVDTATYYCARIESIGTTYS FDYWGQGTMVTVSS |
| 1581 | hBDI-9E8.5 | CDR-H1 | GFSLSTYGMGVG |
| 1582 | hBDI-9E8.5 | CDR-H2 | NIWWDDDKYYNPSLKN |
| 1583 | hBDI-9E8.5 | CDR-H3 | IESIGTTYSFDY |
| 1584 | hBDI-9E8.5 | VL | NFMLTQPHSVSESPGKTVTISCERSSGDIGDSYVSW YQQRPGSSPTTVIYADDQRPSGVPDRFSGSIDSSSN SASLTISGLKTEDEADYYCQSYDINIDIVFGGGTKL TVL |
| 1585 | hBDI-9E8.5 | CDR-L1 | ERSSGDIGDSYVS |
| 1586 | hBDI-9E8.5 | CDR-L2 | ADDQRPS |
| 1587 | hBDI-9E8.5 | CDR-L3 | QSYDINIDIV |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein V Region Region | V Region 12345678901234567890123456789 0 |
|---|---|---|---|
| 1588 | hBDI-9E8.6 | VH | EVTLRESGPALVKPTQTLTLTCTFSGFSLSTYGMGV GWIRQPPGKGLEWLANIWWDDDKYYNPSLKNRLTIS KDTSKNQAVLTITNMDPVDTATYYCARIESIGTTYS FDYWGQGTMVTVSS |
| 1589 | hBDI-9E8.6 | CDR-H1 | GFSLSTYGMGVG |
| 1590 | hBDI-9E8.6 | CDR-H2 | NIWWDDDKYYNPSLKN |
| 1591 | hBDI-9E8.6 | CDR-H3 | IESIGTTYSFDY |
| 1592 | hBDI-9E8.6 | VL | NFMLTQPHSVSESPGKTVTISCERSSGDIGDSYVSW YQQRPGSPPTNVIYADDQRPSGVPDRFSGSIDSSSN SASLTISGLKTEDEADYFCQSYDINIDIVFGGGTKL TVL |
| 1593 | hBDI-9E8.6 | CDR-L1 | ERSSGDIGDSYVS |
| 1594 | hBDI-9E8.6 | CDR-L2 | ADDQRPS |
| 1595 | hBDI-9E8.6 | CDR-L3 | QSYDINIDIV |
| 1596 | hBDI-9E8.7 | VH | EVTLRESGPALVKPTQTLTLTCTFSGFSLSTYGMGV GWIRQPPGKGLEWLANIWWDDDKYYNPSLKNRLTIS KDTSKNQAVLTITNMDPVDTATYYCARIESIGTTYS FDYWGQGTMVTVSS |
| 1597 | hBDI-9E8.7 | CDR-H1 | GFSLSTYGMGVG |
| 1598 | hBDI-9E8.7 | CDR-H2 | NIWWDDDKYYNPSLKN |
| 1599 | hBDI-9E8.7 | CDR-H3 | IESIGTTYSFDY |
| 1600 | hBDI-9E8.7 | VL | EIVLTQSPGTLSLSPGERATLSCERSSGDIGDSYVS WYQQKPGQAPRLLIYADDQRPSGIPDRFSGSGSGTD FTLTISRLEPEDFAVYYCQSYDINIDIVFGGGTKVE IK |
| 1601 | hBDI-9E8.7 | CDR-L1 | ERSSGDIGDSYVS |
| 1602 | hBDI-9E8.7 | CDR-L2 | ADDQRPS |
| 1603 | hBDI-9E8.7 | CDR-L3 | QSYDINIDIV |
| 1604 | hBDI-9E8.8 | VH | EVTLRESGPALVKPTQTLTLTCTFSGFSLSTYGMGV GWIRQPPGKGLEWLANIWWDDDKYYNPSLKNRLTIS KDTSKNQAVLTITNMDPVDTATYYCARIESIGTTYS FDYWGQGTMVTVSS |
| 1605 | hBDI-9E8.8 | CDR-H1 | GFSLSTYGMGVG |
| 1606 | hBDI-9E8.8 | CDR-H2 | NIWWDDDKYYNPSLKN |
| 1607 | hBDI-9E8.8 | CDR-H3 | IESIGTTYSFDY |
| 1608 | hBDI-9E8.8 | VL | EFVLTQSPGTLSLSPGERATLSCERSSGDIGDSYVS WYQQKPGQAPRLVIYADDQRPSGIPDRFSGSGSGTD FTLTISRLEPEDFAVYYCQSYDINIDIVFGGGTKVE IK |
| 1609 | hBDI-9E8.8 | CDR-L1 | ERSSGDIGDSYVS |
| 1610 | hBDI-9E8.8 | CDR-L2 | ADDQRPS |
| 1611 | hBDI-9E8.8 | CDR-L3 | QSYDINIDIV |
| 1612 | hBDI-9E8.9 | VH | EVTLRESGPALVKPTQTLTLTCTFSGFSLSTYGMGV GWIRQPPGKALEWLANIWWDDDKYYNPSLKNRLTIS KDTSKNQAVLTITNMDPVDTATYYCARIESIGTTYS FDYWGQGTTVTVSS |
| 1613 | hBDI-9E8.9 | CDR-H1 | GFSLSTYGMGVG |

TABLE 28-continued

VH and VL Amino Acid Sequences of Humanized Versions of
Rat Anti-Human PDGF-BB Monoclonal Antibodies (CDRs in bold)

| SEQ ID NO: | Clone | Protein Region | V Region 12345678901234567890123456789 0 |
|---|---|---|---|
| 1614 | hBDI-9E8.9 | CDR-H2 | NIWWDDDKYYNPSLKN |
| 1615 | hBDI-9E8.9 | CDR-H3 | IESIGTTYSFDY |
| 1616 | hBDI-9E8.9 | VL | DFVLTQSPDSLAVSLGERATINCERSSGDIGDSYVS WYQQKPGQPPKNVIYADDQRPSGVPDRFSGSGSGNS ASLTISSLQAEDVAVYFCQSYDINIDIVFGGGTKVE IK |
| 1617 | hBDI-9E8.9 | CDR-L1 | ERSSGDIGDSYVS |
| 1618 | hBDI-9E8.9 | CDR-L2 | ADDQRPS |
| 1619 | hBDI-9E8.9 | CDR-L3 | QSYDINIDIV |
| 1620 | hBDI-9E8.4E | VH | EVTLRESGPALVKPTQTLTLTCTFSGFSLSTYGMGV GWIRQPPGKALEWLANIWWDDDKYYNPSLKNRLTIS KDTSKNQVVLTMTNMDPVDTATYYCARIESIGTTYS FDYWGQGTMVTVSS |
| 1621 | hBDI-9E8.4E | CDR-H1 | GFSLSTYGMGVG |
| 1622 | hBDI-9E8.4E | CDR-H2 | NIWWDDDKYYNPSLKN |
| 1623 | hBDI-9E8.4E | CDR-H3 | IESIGTTYSFDY |
| 1624 | hBDI-9E8.4E | VL | EFVLTQSPGTLSLSPGERATLSCERSSGDIGESYVS WYQQKPGQAPRLVIYADDQRPSGIPDRFSGSGSGTD FTLTISRLEPEDFAVYYCQSYDINIDIVFGGGTKVE IK |
| 1625 | hBDI-9E8.4E | CDR-L1 | ERSSGDIGESYVS |
| 1626 | hBDI-9E8.4E | CDR-L2 | ADDQRPS |
| 1627 | hBDI-9E8.4E | CDR-L3 | QSYDINIDIV |
| 1628 | hBFU-3E2.1 | VH | EVQLVQSGAEVKKPGSSVKVSCKASGYTFTESYMYW VKQAPGQGLELIGRIDPEDGSTDYVEKFKNKATLTA DKSTSTAYMELSSLRSEDTAVYFCARFGARSYFYPM DAWGQGTTVTVSS |
| 1629 | hBFU-3E2.1 | CDR-H1 | GYTFTESYMY |
| 1630 | hBFU-3E2.1 | CDR-H2 | RIDPEDGSTDYVEKFKN |
| 1631 | hBFU-3E2.1 | CDR-H3 | FGARSYFYPMDA |
| 1632 | hBFU-3E2.1 | VL | ETVLTQSPATLSLSPGERATLSCRASESVSTLMHWY QQKPGQQPRLLIYGASNLESGVPARFSGSGSGTDFT LTISSLEPEDFAVYFCQQSWNDPWTFGGGTKVEIK |
| 1633 | hBFU-3E2.1 | CDR-L1 | RASESVSTLMH |
| 1634 | hBFU-3E2.1 | CDR-L2 | GASNLES |
| 1635 | hBFU-3E2.1 | CDR-L3 | QQSWNDPWT |
| 1636 | hBFU-3E2.2 | VH | EVQLVQSGAEVKKPGSSVKVSCKASGYTFTESYMYW VRQAPGQGLELIGRIDPEDGSTDYVEKFKNRVTLTA DKSTSTAYMELSSLRSEDTAVYYCARFGARSYFYPM DAWGQGTTVTVSS |
| 1637 | hBFU-3E2.2 | CDR-H1 | GYTFTESYMY |
| 1638 | hBFU-3E2.2 | CDR-H2 | RIDPEDGSTDYVEKFKN |
| 1639 | hBFU-3E2.2 | CDR-H3 | FGARSYFYPMDA |
| 1640 | hBFU-3E2.2 | VL | ETVLTQSPATLSLSPGERATLSCRASESVSTLMHWY QQKPGQQPRLLIYGASNLESGVPARFSGSGSGTDFT LTISSLEPEDFAVYFCQQSWNDPWTFGGGTKVEIK |
| 1641 | hBFU-3E2.2 | CDR-L1 | RASESVSTLMH |

TABLE 28-continued

VH and VL Amino Acid Sequences of Humanized Versions of Rat Anti-Human PDGF-BB Monoclonal Antibodies (CDRs in bold)

| SEQ ID NO: | Clone | Protein Region | V Region 12345678901234567890 1234567890 |
|---|---|---|---|
| 1642 | hBFU-3E2.2 | CDR-L2 | GASNLES |
| 1643 | hBFU-3E2.2 | CDR-L3 | QQSWNDPWT |
| 1644 | hBFU-3E2.3 | VH | EVQLVQSGAEVKKPGSSVKVSCKASGYTFTESYMYW VRQAPGQGLELIGRIDPEDGSTDYVEKFKNKATLTA DKSTSTAYMELSSLRSEDTAVYFCARFGARSYFYPM DAWGQGTTVTVSS |
| 1645 | hBFU-3E2.3 | CDR-H1 | GYTFTESYMY |
| 1646 | hBFU-3E2.3 | CDR-H2 | RIDPEDGSTDYVEKFKN |
| 1647 | hBFU-3E2.3 | CDR-H3 | FGARSYFYPMDA |
| 1648 | hBFU-3E2.3 | VL | ATQLTQSPSSLSASVGDRVTISCRASESVSTLMHWY QQKPGKQPRLLIYGASNLESGVPSRFSGSGSGTDFT LTISSLQPEDFATYFCQQSWNDPWTFGGGTKVEIK |
| 1649 | hBFU-3E2.3 | CDR-L1 | RASESVSTLMH |
| 1650 | hBFU-3E2.3 | CDR-L2 | GASNLES |
| 1651 | hBFU-3E2.3 | CDR-L3 | QQSWNDPWT |
| 1652 | hBFU-3E2.4 | VH | EVQLVQSGAEVKKPGSSVKVSCKASGYTFTESYMYW VRQAPGQGLELIGRIDPEDGSTDYVEKFKNRVTLTA DKSTSTAYMELSSLRSEDTAVYYCARFGARSYFYPM DAWGQGTTVTVSS |
| 1653 | hBFU-3E2.4 | CDR-H1 | GYTFTESYMY |
| 1654 | hBFU-3E2.4 | CDR-H2 | RIDPEDGSTDYVEKFKN |
| 1655 | hBFU-3E2.4 | CDR-H3 | FGARSYFYPMDA |
| 1656 | hBFU-3E2.4 | VL | ATQLTQSPSSLSASVGDRVTISCRASESVSTLMHWY QQKPGKQPRLLIYGASNLESGVPSRFSGSGSGTDFT LTISSLQPEDFATYFCQQSWNDPWTFGGGTKVEIK |
| 1657 | hBFU-3E2.4 | CDR-L1 | RASESVSTLMH |
| 1658 | hBFU-3E2.4 | CDR-L2 | GASNLES |
| 1659 | hBFU-3E2.4 | CDR-L3 | QQSWNDPWT |

TABLE 29

VH and VL Amino Acid Sequences of Humanized Versions of Rat Anti-Human VEGFR II Monoclonal Antibodies (CDRs in bold)

| SEQ ID NO: | Clone | Protein Region | V Region 12345678901234567890123456 |
|---|---|---|---|
| 1660 | hBCU-6B1.1 | VH | EVQLVQSGSELKKPGASVKVSCKASGYTFTNYGMY WVKQAPGQGLEFMGWINTETGQPTYADDFKGRFVF SLDTSVSTAYLQISSLKAEDTAVYFCARLGNNYGI WFAYWGQGTLVTVSS |
| 1661 | hBCU-6B1.1 | CDR-H1 | GYTFTNYGMY |
| 1662 | hBCU-6B1.1 | CDR-H2 | WINTETGQPTYADDFKG |
| 1663 | hBCU-6B1.1 | CDR-H3 | LGNNYGIWFAY |
| 1664 | hBCU-6B1.1 | VL | DIQMTQSPSSLSASVGDRVTIECRASDDLYSTLAW YQQKPGKSPKLLIFDANRLAAGVPSRFSGSGSGTD YSLTISSLQPEDVATYFCQQYNKFPWTFGGGTKVE IK |

TABLE 29-continued

VH and VL Amino Acid Sequences of Humanized Versions of
Rat Anti-Human VEGFR II Monoclonal Antibodies (CDRs in bold)

| SEQ ID NO: | Clone | Protein Region | V Region 12345678901234567890123456 |
|---|---|---|---|
| 1665 | hBCU-6B1.1 | CDR-L1 | RASDDLYSTLA |
| 1666 | hBCU-6B1.1 | CDR-L2 | DANRLAA |
| 1667 | hBCU-6B1.1 | CDR-L3 | QQYNKFPWT |
| 1668 | hBCU-6B1.2 | VH | EVQLVQSGAEVKKPGASVKVSCKASGYTFTNYGMYWVKQAPGQGLEFMGWINTETGQPTYADDFKGRFTFTLDTSTSTAYMELRSLRSDDTAVYFCARLGNNYGIWFAYWGQGTLVTVSS |
| 1669 | hBCU-6B1.2 | CDR-H1 | GYTFTNYGMY |
| 1670 | hBCU-6B1.2 | CDR-H2 | WINTETGQPTYADDFKG |
| 1671 | hBCU-6B1.2 | CDR-H3 | LGNNYGIWFAY |
| 1672 | hBCU-6B1.2 | VL | DIQMTQSPSSLSASVGDRVTIECRASDDLYSTLAWYQQKPGKSPKLLIFDANRLAAGVPSRFSGSGSGTDYSLTISSLQPEDVATYFCQQYNKFPWTFGGGTKVEIK |
| 1673 | hBCU-6B1.2 | CDR-L1 | RASDDLYSTLA |
| 1674 | hBCU-6B1.2 | CDR-L2 | DANRLAA |
| 1675 | hBCU-6B1.2 | CDR-L3 | QQYNKFPWT |
| 1676 | hBCU-6B1.3 | VH | EVQLVQSGAEVKKPGASVKVSCKASGYTFTNYGMYWVRQAPGQGLEFMGWINTETGQPTYADDFKGRFTFTLDTSTSTAYMELRSLRSDDTAVYYCARLGNNYGIWFAYWGQGTLVTVSS |
| 1677 | hBCU-6B1.3 | CDR-H1 | GYTFTNYGMY |
| 1678 | hBCU-6B1.3 | CDR-H2 | WINTETGQPTYADDFKG |
| 1679 | hBCU-6B1.3 | CDR-H3 | LGNNYGIWFAY |
| 1680 | hBCU-6B1.3 | VL | DIQMTQSPSSLSASVGDRVTIECRASDDLYSTLAWYQQKPGKSPKLLIFDANRLAAGVPSRFSGSGSGTDYSLTISSLQPEDVATYFCQQYNKFPWTFGGGTKVEIK |
| 1681 | hBCU-6B1.3 | CDR-L1 | RASDDLYSTLA |
| 1682 | hBCU-6B1.3 | CDR-L2 | DANRLAA |
| 1683 | hBCU-6B1.3 | CDR-L3 | QQYNKFPWT |
| 1684 | hBCU-6B1.4 | VH | EVQLVQSGAEVKKPGASVKVSCKASGYTFTNYGMYWVRQAPGQGLEFMGWINTETGQPTYADDFKGRFTFTLDTSTSTAYMELRSLRSDDTAVYYCARLGNNYGIWFAYWGQGTLVTVSS |
| 1685 | hBCU-6B1.4 | CDR-H1 | GYTFTNYGMY |
| 1686 | hBCU-6B1.4 | CDR-H2 | WINTETGQPTYADDFKG |
| 1687 | hBCU-6B1.4 | CDR-H3 | LGNNYGIWFAY |
| 1688 | hBCU-6B1.4 | VL | DIQMTQSPSSLSASVGDRVTITCRASDDLYSTLAWYQQKPGKSPKLLIFDANRLAAGVPSRFSGSGSGTDYTLTISSLQPEDVATYFCQQYNKFPWTFGGGTKVEIK |
| 1689 | hBCU-6B1.4 | CDR-L1 | RASDDLYSTLA |
| 1690 | hBCU-6B1.4 | CDR-L2 | DANRLAA |
| 1691 | hBCU-6B1.4 | CDR-L3 | QQYNKFPWT |

TABLE 30

VH and VL Amino Acid Sequences of Humanized Versions of
Rat Anti-Human PDGFR b Monoclonal Antibodies (CDRs in bold)

| SEQ ID NO: | Clone | Protein Region | V Region 12345678901234567890123456 7890 |
|---|---|---|---|
| 1692 | hBDE-3C9.1 | VH | EVQLVESGGGLVQPGGSLRLSCAASGFTFSNYGMAWVRQAPGKGLEWVASITNSGGNTYYRDSVKGRFTISRDNAKNTQYLQMNSLRAEDTAVYFCARHTPGANYFDYWGQGTMVTVSS |
| 1693 | hBDE-3C9.1 | CDR-H1 | GFTFSNYGMA |
| 1694 | hBDE-3C9.1 | CDR-H2 | SITNSGGNTYYRDSVKG |
| 1695 | hBDE-3C9.1 | CDR-H3 | HTPGANYFDY |
| 1696 | hBDE-3C9.1 | VL | DIQMTQSPSSLSASVGDRVTITCQASQSIKNYIAWYQLKPGKAPRLLMRYTSTLESGTPSRFSGSGSGRDYTFTISSLQPEDIATYYCVQYANLYTFGGGTKVEIK |
| 1697 | hBDE-3C9.1 | CDR-L1 | QASQSIKNYIA |
| 1698 | hBDE-3C9.1 | CDR-L2 | YTSTLES |
| 1699 | hBDE-3C9.1 | CDR-L3 | VQYANLYT |
| 1700 | hBDE-3C9.2 | VH | EVQLVESGGGLVQPGGSLRLSCAASGFTFSNYGMAWVRQAPGKGLEWVASITNSGGNTYYRDSVKGRFTISRDNAKNSLYLQMNSLRAEDTAVYYCARHTPGANYFDYWGQGTMVTVSS |
| 1701 | hBDE-3C9.2 | CDR-H1 | GFTFSNYGMA |
| 1702 | hBDE-3C9.2 | CDR-H2 | SITNSGGNTYYRDSVKG |
| 1703 | hBDE-3C9.2 | CDR-H3 | HTPGANYFDY |
| 1704 | hBDE-3C9.2 | VL | DIQMTQSPSSLSASVGDRVTITCQASQSIKNYIAWYQQKPGKAPRLLIRYTSTLESGVPSRFSGSGSGRDYTFTISSLQPEDIATYYCVQYANLYTFGGGTKVEIK |
| 1705 | hBDE-3C9.2 | CDR-L1 | QASQSIKNYIA |
| 1706 | hBDE-3C9.2 | CDR-L2 | YTSTLES |
| 1707 | hBDE-3C9.2 | CDR-L3 | VQYANLYT |

Generation of Humanized Antibodies

All variants were cloned into pHybE vectors and were transiently transfected into 50 mls of HEK 2936e suspension cell cultures in a ratio of 60% to 40% light to heavy chain construct. 1 mg/ml PEI was used to transfect the cells. Cell supernatants were harvested after six days in shaking flasks, spun down to pellet cells, and filtered through 0.22 µm filters to separate IgG from culture contaminates. All were batch purified by adding 1 supernatant volume of protein A IgG binding buffer (Thermo Scientific 21001) and 1 ml of rProteinA sepharose fast flow beads (GE Healthcare, 17-1279-04). Supernatants, with beads and buffer added, were rocked overnight at 4° C., and the day after beads were collected by gravity over poly prep chromatography columns (Bio Rad, 731-1550). Once supernatants had passed through the columns the beads were washed with 10 column volumes of binding buffer, and IgG was eluted with Immunopure IgG elution buffer (Pierce, 185 1520) and collected in 1 ml aliquots. Fractions containing IgG were pooled and dialyzed in 15 mM Histidine pH 6 overnight at 4° C.

Purified variants were further characterized for their affinities for recombinant human target proteins by binding ELISA, by Biacore, and by cell-based potency assays.

TABLE 31

Summary of Protein Expression and Purification for Humanized Anti-Human VEGF-A And Humanized Anti-Human PDGF-BB Monoclonal Antibodies

| Name | Octet Titer (mg/L)[1] | ~Yield (mg/L)[2] | SEC (% monomer)[3] |
|---|---|---|---|
| hBDB-4G8.1 | 19.9 | 19.7 | 100.0 |
| hBDB-4G8.2 | 105.3 | 95.8 | 100.0 |
| hBDB-4G8.3 | 34.8 | 31.9 | 100.0 |
| hBDB-4G8.4 | 45.8 | 34.2 | 100.0 |
| hBDB-4G8.5 | 24.7 | 27.4 | 100.0 |
| hBDB-4G8.6 | 28.6 | 34.2 | 100.0 |
| hBDB-4G8.7 | 75.8 | 63.4 | 100.0 |
| hBDB-4G8.8 | 145.9 | 101.4 | 100.0 |
| hBDB-4G8.9 | 38.8 | 39.0 | 100.0 |
| hBDB-4G8.10 | 40.7 | 32.9 | 89.1 |
| hBDB-4G8.11 | 47.9 | 38.0 | 87.2 |
| hBDB-4G8.12 | 37.5 | 38.3 | 100.0 |
| hBDB-4G8.13 | 44.8 | 35.1 | 100.0 |
| hBDB-4G8.14 | 73.0 | 47.0 | 100.0 |
| hBDB-4G8.15 | 161.2 | 94.9 | 100.0 |
| hBDI-5H1.1 | 49.8 | 38.7 | 100.0 |
| hBDI-5H1.2 | 63.4 | 62.0 | 100.0 |
| hBDI-5H1.3 | 94.2 | 86.5 | 99.1 |

TABLE 31-continued

Summary of Protein Expression and Purification for Humanized Anti-Human VEGF-A And Humanized Anti-Human PDGF-BB Monoclonal Antibodies

| Name | Octet Titer (mg/L)[1] | ~Yield (mg/L)[2] | SEC (% monomer)[3] |
|---|---|---|---|
| hBDI-5H1.4 | 109.0 | 123.1 | 99.2 |
| hBDI-5H1.5 | 23.0 | 27.7 | 100.0 |
| hBDI-5H1.6 | 41.2 | 46.0 | 100.0 |
| hBDI-5H1.7 | 9.6 | 9.6 | 88.1 |
| hBDI-5H1.8 | 36.0 | 41.5 | 100.0 |
| hBDI-5H1.9 | 56.0 | 60.2 | 85.6 |
| hBDI-5H1.10 | 34.2 | 31.1 | 85.2 |
| hBDI-5H1.11 | 41.0 | 34.4 | 96.3 |
| hBDI-5H1.12 | 37.7 | 30.2 | 100.0 |
| hBDI-9E8.1 | 90.0 | 72.4 | 100.0 |
| hBDI-9E8.2 | 89.9 | 89.1 | 99.3 |
| hBDI-9E8.3 | 28.8 | 24.4 | 97.1 |
| hBDI-9E8.4 | 52.8 | 54.8 | 98.2 |
| hBDI-9E8.5 | 78.0 | 57.7 | 100.0 |
| hBDI-9E8.6 | 60.6 | 61.4 | 100.0 |
| hBDI-9E8.7 | 30.4 | 27.9 | 88.1 |
| hBDI-9E8.8 | 37.1 | 38.0 | 98.4 |
| hBDI-9E8.9 | 50.3 | 44.9 | 94.6 |
| hBDI-9E8.10 | 93.0 | 56.2 | 94.7 |
| hBDI-9E8.11 | 78.4 | 52.7 | 99.1 |
| hBDI-9E8.12 | 92.3 | 68.5 | 100.0 |
| hBDI-5H1.13 | 13.6 | 10.5 | 88.1 |
| hBDI-9E8.13 | 53.5 | 66.9 | 100.0 |
| hBDI-1E1.1 | 133.5 | ND | ND |
| hBDI-1E1.2 | 115.6 | ND | ND |
| hBDI-1E1.3 | 83.4 | ND | ND |
| hBDI-1E1.4 | 137.6 | ND | ND |
| hBDI-1E1.5 | 97.4 | ND | ND |
| hBDI-1E1.6 | 70.6 | ND | ND |
| hBDI-1E1.7 | 91.9 | ND | ND |
| hBDI-1E1.8 | 71.2 | ND | ND |
| hBDI-1E1.9 | 94.3 | ND | ND |
| hBDI-1E1.10 | 72.7 | ND | ND |
| hBDI-1E1.11 | 57.4 | ND | ND |
| hBDI-1E1.12 | 151.6 | ND | ND |
| hBEW-9A8.1 | 0.2 | ND | ND |
| hBEW-9A8.2 | 0.2 | ND | ND |
| hBEW-9A8.3 | 0.2 | ND | ND |
| hBEW-9A8.4 | 0.2 | ND | ND |
| hBEW-9A8.5 | 0.5 | ND | ND |
| hBEW-9A8.6 | 0.2 | ND | ND |
| hBEW-9A8.7 | 0.3 | ND | ND |
| hBEW-9A8.8 | 3.5 | ND | ND |
| hBEW-9A8.9 | 15.3 | 18.6 | ND |
| hBEW-9A8.10 | 5.2 | ND | ND |
| hBEW-9A8.11 | 30.6 | 18.9 | ND |
| hBEW-9A8.12 | 38.3 | 28.4 | ND |
| hBEW-9A8.13 | 0.4 | ND | ND |
| hBEW-9A8.14 | 0.3 | ND | ND |
| hBEW-9A8.15 | 0.3 | ND | ND |
| hBEW-9A8.16 | 3.2 | ND | ND |
| hBEW-6C2.1 | 5.4 | ND | ND |
| hBEW-6C2.2 | 1.5 | ND | ND |
| hBEW-6C2.3 | 14.8 | 7.8 | ND |
| hBEW-6C2.4 | 79.6 | 29.5 | ND |
| hBEW-6C2.5 | 4.7 | ND | ND |
| hBEW-6C2.6 | 3.9 | ND | ND |
| hBEW-6C2.7 | 140.8 | 39.7 | ND |
| hBEW-6C2.8 | 75.3 | 24.8 | ND |
| hBDI-5H1.16 | ND | 23.9 | 93.4 |
| hBDI-5H1.17 | ND | 21.0 | 92.1 |
| hBFU-3E2.1 | ND | 40.2 | 88.1 |
| hBFU-3E2.2 | ND | 34.6 | 93.6 |
| hBFU-3E2.3 | ND | 33.6 | 84.2 |
| hBFU-3E2.4 | ND | 38.4 | 94.7 |
| hBEW-9A8.17 | ND | 20.0 | 98.7 |
| hBEW-9A8.20 | ND | 17.6 | 86.6 |
| hBEW-9A8.21 | ND | 13.3 | 97.5 |
| hBEW-5C3.1 | ND | 20.8 | 85.0 |
| hBEW-5C3.2 | ND | 17.7 | 74.6 |
| hBEW-5C3.3 | ND | 6.9 | 93.7 |
| hBEW-5C3.4 | ND | 32.0 | 88.7 |
| hBEW-5C3.5 | ND | 30.6 | 85.1 |
| hBEW-5C3.6 | ND | 19.4 | 75.4 |
| hBEW-9E10.1 | ND | 42.7 | 98.0 |
| hBEW-9E10.2 | ND | 46.1 | 98.0 |
| hBEW-9E10.3 | ND | 45.9 | 97.6 |
| hBEW-9E10.4 | ND | 47.1 | 98.0 |
| hBEW-9E10.5 | ND | 56.2 | 97.9 |
| hBEW-9E10.6 | ND | 52.9 | 97.6 |
| hBEW-1B10.1 | ND | 34.1 | 97.8 |
| hBEW-1B10.2 | ND | 45.3 | 98.1 |
| hBEW-1E3.1 | ND | 29.6 | 95.5 |
| hBEW-1E3.2 | ND | 20.9 | 98.3 |
| hBEW-1E3.3 | ND | 22.0 | 98.5 |
| hBEW-1E3.4 | ND | 48.0 | 98.1 |
| hBEW-1E3.5 | ND | 23.8 | 98.5 |
| hBEW-1E3.6 | ND | 17.0 | 98.7 |

ND = Not Determined
[1]Octet titer is the amout of IgG in the unpurified supernatant as determined by protein A binding compared to a standard curve using an Octet instrument.
[2]Yield is determined by the total amount of purified protein in mg divided by the total cell culture volume in liters.
[3]SEC % monomer is determined using HPLC size exclusion chromatography.

Humanized anti-VEGF antibodies were tested for their binding to human VEGF-A according to the method described in Example 1.1. The on-rate, off-rate and binding kinetics are summarized in Table 32 below.

TABLE 32

Biacore Binding of Humanized Anti-VEGF Antibodies

| Antibody | $k_{on}$ (M-1 s-1) | $k_{off}$ (M-1) | $K_D$ (M) |
|---|---|---|---|
| hBDB-4G8.1 | 1.8E+07 | 1.0E−04 | 5.8E−12 |
| hBDB-4G8.2 | 1.7E+07 | 6.2E−05 | 3.6E−12 |
| hBDB-4G8.3 | 1.0E+07 | 4.8E−05 | 4.8E−12 |
| hBDB-4G8.4 | 2.7E+07 | 1.5E−04 | 5.5E−12 |
| hBDB-4G8.5 | 2.5E+07 | 4.0E−05 | 1.6E−12 |
| hBDB-4G8.6 | 2.6E+07 | 3.7E−05 | 1.4E−12 |
| hBDB-4G8.7 | 3.7E+07 | 1.3E−03 | 3.4E−11 |
| hBDB-4G8.8 | 1.8E+07 | 8.6E−04 | 4.7E−11 |
| hBDB-4G8.9 | 1.4E+07 | 8.8E−04 | 6.2E−11 |
| hBDB-4G8.10 | 2.7E+07 | 2.2E−04 | 8.1E−12 |
| hBDB-4G8.11 | 2.6E+07 | 3.4E−05 | 1.3E−12 |
| hBDB-4G8.12 | 2.6E+07 | 3.2E−05 | 1.2E−12 |
| hBDB-4G8.13 | 2.2E+07 | 1.7E−04 | 7.6E−12 |
| hBDB-4G8.14 | 1.5E+07 | 5.6E−05 | 3.7E−12 |
| hBDB-4G8.15 | 2.0E+07 | 8.7E−05 | 4.4E−12 |
| hBEW-9A8.9 | 1.0E+07 | 8.2E−03 | 8.2E−10 |
| hBEW-9A8.11 | 1.5E+07 | 1.1E−03 | 7.4E−11 |
| hBEW-9A8.12 | 9.6E+06 | 1.4E−04 | 1.5E−11 |
| hBEW-9A8.17 | 7.9E+06 | 1.4E−05 | 1.7E−12 |
| hBEW-9A8.20 | 7.6E+06 | 1.2E−05 | 1.6E−12 |
| hBEW-9A8.21 | 5.8E+06 | 3.9E−05 | 6.7E−12 |
| hBEW-5C3.1 | 1.1E+07 | 6.9E−05 | 6.0E−12 |
| hBEW-5C3.4 | 9.9E+06 | 8.5E−05 | 8.6E−12 |
| hBEW-5C3.5 | 1.2E+07 | 9.7E−05 | 8.5E−12 |
| hBEW-9E10.1 | 1.2E+07 | 2.5E−05 | 2.1E−12 |
| hBEW-9E10.2 | 1.6E+07 | 1.9E−04 | 1.2E−11 |
| hBEW-9E10.3 | 1.3E+07 | 4.2E−05 | 3.2E−12 |
| hBEW-9E10.4 | 1.2E+07 | 2.5E−05 | 2.1E−12 |
| hBEW-9E10.5 | 1.6E+07 | 2.3E−04 | 1.5E−11 |
| hBEW-9E10.6 | 1.5E+07 | 4.0E−05 | 2.6E−12 |
| hBEW-1B10.1 | 7.6E+06 | 1.4E−04 | 1.8E−11 |
| hBEW-1B10.2 | 7.5E+06 | 1.5E−04 | 2.0E−11 |
| hBEW-1E3.1 | 1.1E+07 | 8.5E−05 | 7.7E−12 |
| hBEW-1E3.2 | 1.1E+07 | 1.0E−04 | 9.2E−12 |
| hBEW-1E3.4 | 9.8E+06 | 9.6E−05 | 9.7E−12 |
| hBEW-1E3.5 | 1.0E+07 | 1.0E−04 | 1.0E−11 |

Humanized anti-VEGF-A antibodies were tested for potency against $hVEGF_{165}$-induced cell proliferation in one of two cellular assay formats. The HMVEC-d bioassay utilizes cells which natively express VEGFR2 (Example 1.10). The VEGFR2-3T3 cells are stably transfected with VEGFR2 (Example 1.7). The data is summarized in Table 33 below.

TABLE 33

Summary of Characterization of Humanized Anti-Human VEGF-A Monoclonal Antibodies.

| Humanized Molecules | hVEGF$_{165}$ IC50 (nM) | |
| --- | --- | --- |
| | HMVEC-d | VEGFR2-3T3 |
| hBDB-4G8.1 | NT | 0.847 |
| hBDB-4G8.2 | NT | 0.603 |
| hBDB-4G8.3 | NT | 0.665 |
| hBDB-4G8.3 half-body | NT | >10 |
| hBDB-4G8.4 | NT | 0.918 |
| hBDB-4G8.5 | NT | 0.620 |
| hBDB-4G8.6 | NT | 0.488 |
| hBDB-4G8.7 | NT | >10 |
| hBDB-4G8.8 | NT | >10 |
| hBDB-4G8.9 | NT | >10 |
| hBDB-4G8.10 | NT | >10 |
| hBDB-4G8.11 | NT | 0.385 |
| hBDB-4G8.12 | NT | 0.563 |
| hBDB-4G8.13 | NT | 0.791 |
| hBDB-4G8.14 | NT | 0.499 |
| hBDB-4G8.15 | NT | 0.963 |
| hBEW-1B10.1 | 0.168 | NT |
| hBEW-1B10.2 | 0.222 | NT |
| hBEW-1E3.1 | 0.138 | NT |
| hBEW-1E3.4 | 0.212 | NT |
| hBEW-1E3.2 | 0.161 | NT |
| hBEW-1E3.3 | 0.205 | NT |
| hBEW-1E3.5 | 0.184 | NT |
| hBEW-1E3.6 | 0.26 | NT |
| hBEW-5C3.1 | 0.071 | NT |
| hBEW-5C3.2 | 0.162 | NT |
| hBEW-5C3.3 | >2 | NT |
| hBEW-5C3.4 | 0.098 | NT |
| hBEW-5C3.5 | 0.123 | NT |
| hBEW-5C3.6 | >2 | NT |
| hBEW-9A8.9 | NT | >10 |
| hBEW-9A8.11 | NT | >10 |
| hBEW-9A8.12 | NT | 0.598 |
| hBEW-9A8.17 | 0.059 | NT |
| hBEW-9A8.20 | 0.064 | NT |
| hBEW-9A8.21 | 0.09 | NT |
| hBEW-9E10.1 | 0.064 | NT |
| hBEW-9E10.2 | 0.181 | NT |
| hBEW-9E10.3 | 0.062 | NT |
| hBEW-9E10.4 | 0.071 | NT |
| hBEW-9E10.5 | 0.229 | NT |
| hBEW-9E10.6 | 0.068 | NT |

NT = Not tested

Humanized anti-PDGF-BB antibodies were tested for their binding to human PDGF-BB according to the method described in Example 1.1. The on-rate, off-rate and binding kinetics are summarized in Table 34 below.

TABLE 34

Biacore Binding of Humanized Anti-PDGF Antibodies

| Antibody | $k_{on}$ (M−1 s−1) | $k_{off}$ (M−1) | $K_D$ (M) |
| --- | --- | --- | --- |
| hBDI-9E8.1 | ≥1.0E+07 | 5.6E−03 | ≤5.6E−10 |
| hBDI-9E8.2 | ≥1.0E+07 | 5.1E−03 | ≤5.1E−10 |
| hBDI-9E8.3 | ≥1.0E+07 | 6.5E−04 | ≤6.5E−11 |
| hBDI-9E8.4 | >1.0E+07 | 2.1E−04 | ≤2.1E−11 |
| hBDI-9E8.5 | ≥1.0E+07 | 2.1E−03 | ≤2.1E−10 |
| hBDI-9E8.6 | ≥1.0E+07 | 2.1E−03 | ≤2.1E−10 |
| hBDI-9E8.7 | ≥1.0E+07 | 4.5E−04 | ≤4.5E−11 |

TABLE 34-continued

Biacore Binding of Humanized Anti-PDGF Antibodies

| Antibody | $k_{on}$ (M−1 s−1) | $k_{off}$ (M−1) | $K_D$ (M) |
| --- | --- | --- | --- |
| hBDI-9E8.8 | ≥1.0E+07 | 1.7E−04 | ≤1.7E−11* |
| hBDI-9E8.9 | ≥1.0E+07 | 1.5E−03 | ≤1.5E−10 |
| hBDI-9E8.10 | ≥1.0E+07 | 1.8E−03 | ≤1.8E−10 |
| hBDI-9E8.11 | ≥1.0E+07 | 7.4E−04 | ≤7.4E−11 |
| hBDI-9E8.12 | ≥1.0E+07 | 2.1E−03 | ≤2.1E−10 |
| hBDI-9E8.13 | ≥1.0E+07 | 1.0E−03* | ≤1.0E−10* |
| hBDI-5H1.1 | ≥1.0E+07 | 4.1E−03 | ≤4.1E−10 |
| hBDI-5H1.2 | ≥1.0E+07 | 1.9E−03 | ≤1.9E−10 |
| hBDI-5H1.3 | ≥1.0E+07 | 4.5E−03 | ≤4.5E−10 |
| hBDI-5H1.4 | ≥1.0E+07 | 1.4E−02 | ≤1.4E−09 |
| hBDI-5H1.5 | ≥1.0E+07 | 1.7E−03 | ≤1.7E−10 |
| hBDI-5H1.6 | ≥1.0E+07 | 8.2E−04 | ≤8.2E−11 |
| hBDI-5H1.7 | ≥1.0E+07 | 2.9E−02* | ≤2.9E−09* |
| hBDI-5H1.8 | ≥1.0E+07 | 7.2E−01* | ≤7.2E−08* |
| hBDI-5H1.9 | ≥1.0E+07 | 3.1E−03 | ≤3.1E−10 |
| hBDI-5H1.10 | ≥1.0E+07 | 2.3E−03 | ≤2.3E−10 |
| hBDI-5H1.11 | ≥1.0E+07 | 3.7E−03 | ≤3.7E−10 |
| hBDI-5H1.12 | ≥1.0E+07 | 2.3E−03 | ≤2.3E−10 |
| hBDI-5H1.13 | ≥1.0E+07 | 4.9E−03* | ≤4.9E−10* |

*Heterogeneous off-rate

Humanized anti-PDGF-BB antibodies were tested for potency against hPDGF-BB in functional assays. The ability to neutralize hPDGF-BB-induced cell proliferation was assessed (Example 1.15) as well as the ability to block binding of hPDGF-BB to hPDGF-Rβ in a competition ELISA format (Example 1.13). The data is summarized in Table 35 below.

TABLE 35

Summary of Characterization of Humanized Anti-Human PDGF-BB Monoclonal Antibodies

| Humanized Molecules | hPDGF-BB IC50 (nM) | hPDGF-BB/hPDGFRβ Competition IC50 (nM) |
| --- | --- | --- |
| hBDI-9E8.1 | >5 | + |
| hBDI-9E8.2 | >5 | + |
| hBDI-9E8.3 | 1.583 | + |
| hBDI-9E8.4 | 0.061 | 4.301 |
| hBDI-9E8.4 half body | >5 | NT |
| hBDI-9E8.5 | >5 | + |
| hBDI-9E8.6 | >5 | + |
| hBDI-9E8.7 | 0.350 | + |
| hBDI-9E8.8 | 0.105 | + |
| hBDI-9E8.9 | 0.574 | + |
| hBDI-9E8.10 | 0.562 | + |
| hBDI-9E8.11 | 0.309 | 1.730 |
| hBDI-9E8.12 | 0.525 | + |
| hBDI-5H1.1 | <10 | + |
| hBDI-5H1.2 | <10 | + |
| hBDI-5H1.3 | <10 | − |
| hBDI-5H1.4 | <10 | − |
| hBDI-5H1.9 | <10 | + |
| hBDI-5H1.10 | <10 | − |
| hBDI-5H1.11 | <10 | + |
| hBDI-5H1.12 | <10 | − |
| hBDI-5H1.5 | <10 | + |
| hBDI-5H1.6 | <10 | + |
| hBDI-5H1.7 | <10 | − |
| hBDI-5H1.8 | <10 | − |
| hBDI-5H1.13 | <10 | + |
| hBDI-5H1.16 | <10 | NT |
| hBDI-5H1.17 | <10 | NT |
| hBFU-3E2.1 | 0.183 | NT |
| hBFU-3E2.2 | 0.659 | NT |
| hBFU-3E2.3 | 0.335 | NT |
| hBFU-3E2.4 | 0.571 | NT |

NT—Not tested

Humanized anti-VEGFR2 antibodies were tested for potency against hVEGFR2 in functional assay formats. The antibodies were characterized for the ability to block VEGFR2 binding to hVEGF$_{165}$ in a competition ELISA format (Example 1.22). The antibodies were also tested for the ability to bind exogeneous hVEGFR2 and allow signaling in response to hVEGF$_{165}$ (Example 1.23). The data is summarized in Table 36 below.

TABLE 36

Summary of Characterization of Humanized Anti-Human VEGFR II Monoclonal Antibodies.

| Humanized Molecules | Potency (nM) | |
|---|---|---|
| | hVEGF$_{165}$/ hVEGFR2-Fc Competition | hVEGF$_{165}$/ Tyr1054 phospho-assay |
| hBCU-6B1.1 | 0.474 | NT |
| hBCU-6B1.2 | 0.340 | NT |
| hBCU-6B1.3 | 0.319 | NT |
| hBCU-6B1.4 | 0.335 | NT |

NT—Not tested

Humanized anti-PDGF-Rβ antibodies were characterized for activity in functional assays. Antibodies were assessed for the ability to bind hPDGF-Rβ (Example 1.26) and block binding of hPDGF-Rβ to hPDGF-BB in a competition ELISA format (Example 1.27). They were also tested for the ability to bind exogenoeous hPDGF-Rβ and allow signaling in response to hPDGF-BB (Example 1.28). The data is summarized in Table 37 below.

TABLE 37

Summary of Characterization of Humanized Anti-Human PDGFR-B Monoclonal Antibodies

| Humanized Molecules | Potency (nM) | | |
|---|---|---|---|
| | hPDGFRβ-Fc Binding | hPDGF-BB/ hPDGFRβ-Fc Competition | hPDGF-BB Tyr751 phospho-assay |
| hBDE-3C9.1 | NT | 0.217 | 1.053 |
| hBDE-3C9.2 | NT | 0.260 | 0.882 |

NT—Not tested

Example 7: Affinity Maturation of Anti-Human VEGF-A Antibody 4G8

Library Designs And Strategy

Two different hBDB-4G8.3 parental sequences were made: One with "DT" and another with "EI" at the beginning of VL. Both parentals were tested as scFv, and the "EI" was chosen as the template for the libraries. Two libraries were made by dope primers: HC and LC. After library selection and diversity reduction, libraries were combined into one recombined library (rHC+LC). Final selected clones from each of 3 libraries were converted to IgG.

HC Library
Doping (X) 11 residues at 76080808: 30, 31, 33, 53, 56, 58, 95, 96, 100, 100a and 100c
Co-evolve (1): D61Q/D62G/K64T. Library will contain DDFKG (SEQ ID NO: 1708) or QGFTG (SEQ ID NO: 1709)
A 10$^9$ library will be able to sample mutants carrying up to 4 doped residues at least 4 times. On average, library members will have 5 doped residues.

LC Library
Doping (X) 10 residues at 76080808: 30, 31, 32, 50, 53, 91-94 and 96
Germline toggle (Z): E27Q, V58I and F87Y
Co-evolve (1): M33L/H34A. Library will contain HMHW (SEQ ID NO: 1710) or YLAW (SEQ ID NO: 1711)
A 10$^9$ library will be able to sample mutants carrying up to 4 doped residues at least 4 times. On average, library members will have 5 doped residues.

Recombined Library
H1+H2 library is recombined with H3 library into a HC library. HC library is combined with LC library for a total recombined library rHC+LC.

Codons Specified for Residues to be Doped
For instance, if a proline is to be doped, the doping oligo will have C$_{(5-85-5-5)}$C$_{(5-85-5-5)}$S codon regardless of the original codon in the antibody sequence. These codons are selected based on the following criteria: Increase non-synonymous mutation; increase coverage of more amino acids when mutated; and uses high frequency codons and avoid SSS and WWW codons Doping Order is A-C-G-T

| | | | |
|---|---|---|---|
| A$_{(70-10-10-10)}$ | C$_{(10-70-10-10)}$ | G$_{(10-10-70-10)}$ | T$_{(10-10-10-70)}$ |
| Alanine (A): | | | |
| GCN | | G$_{(10-10-70-10)}$ C$_{(10-70-10-10)}$ S | |
| Threonine (T): | | | |
| ACN | | A$_{(70-10-10-10)}$ C$_{(10-70-10-10)}$ S | |
| Proline (P): | | | |
| CCN | | C$_{(10-70-10-10)}$ C$_{(10-70-10-10)}$ S | |
| Serine (S): | | | |
| TCN | | T$_{(10-10-10-70)}$ C$_{(10-70-10-10)}$ S | |
| AGY | | A$_{(70-10-10-10)}$ G$_{(10-10-70-10)}$ C$_{(10-70-10-10)}$ | |
| Valine (V): | | | |
| GTN | | G$_{(10-10-70-10)}$ T$_{(10-10-10-70)}$ S | |
| Glycine (G): | | | |
| GGN | | G$_{(10-10-70-10)}$ G$_{(10-10-70-10)}$ S | |
| Leucine (L): | | | |
| CTN | | C$_{(10-70-10-10)}$ T$_{(10-10-10-70)}$ S | |
| TTR | | T$_{(10-10-10-70)}$ T$_{(10-10-10-70)}$ G$_{(10-10-70-10)}$ | |
| Arginine (R): | | | |
| CGN | | C$_{(10-70-10-10)}$ G$_{(10-10-70-10)}$ S | |
| AGR | | A$_{(70-10-10-10)}$ G$_{(10-10-70-10)}$ G$_{(10-10-70-10)}$ | |
| Methionine (M): | | | |
| ATG | | A$_{(70-10-10-10)}$ T$_{(10-10-10-70)}$ G$_{(10-10-70-10)}$ | |
| Tryptophan (W): | | | |
| TGG | | T$_{(10-10-10-70)}$ G$_{(10-10-70-10)}$ G$_{(10-10-70-10)}$ | |
| Pheylalanine (F): | | | |
| TTY | | T$_{(10-10-10-70)}$ T$_{(10-10-10-70)}$ C$_{(10-70-10-10)}$ | |
| Isoleucine (I): | | | |
| 50% ATY | | A$_{(70-10-10-10)}$ T$_{(10-10-10-70)}$ C$_{(10-70-10-10)}$ | |
| 50% ATA | | A$_{(70-10-10-10)}$ T$_{(10-10-10-70)}$ A$_{(70-10-10-10)}$ | |
| Tyrosine (Y): | | | |
| TAY | | T$_{(10-10-10-70)}$ A$_{(70-10-10-10)}$ C | |
| Histidine (H): | | | |
| CAY | | C$_{(10-70-10-10)}$ A$_{(70-10-10-10)}$ C$_{(10-70-10-10)}$ | |
| Glutamine (Q): | | | |
| CAR | | C$_{(10-70-10-10)}$ A$_{(70-10-10-10)}$ G$_{(10-10-70-10)}$ | |
| Asparagine (N): | | | |
| AAY | | A$_{(70-10-10-10)}$ A$_{(70-10-10-10)}$ C$_{(10-70-10-10)}$ | |
| Lysine (K): | | | |
| AAR | | A$_{(70-10-10-10)}$ A$_{(70-10-10-10)}$ G$_{(10-10-70-10)}$ | |
| Aspartic Acid (D): | | | |
| GAY | | G$_{(10-10-70-10)}$ A$_{(70-10-10-10)}$ C$_{(10-70-10-10)}$ | |
| Glutamic acid (E): | | | |
| GAR | | G$_{(10-10-70-10)}$ A$_{(70-10-10-10)}$ G$_{(10-10-70-10)}$ | |
| Cysteine (C): | | | |
| TGY | | NNS | |

List of Amino Acid Sequences of Affinity Matured H4g8.3 VH Variants.

Table 38 provides a list of amino acid sequences of unique, functional VH regions of affinity matured humanized anti-VEGF antibodies derived from hBDB-4G8.3. Amino acid residues of individual CDRs of each VH sequence are indicated in bold.

TABLE 38

List of Amino Acid Sequences of
Affinity Matured H4q8.3 VH Variants

| Clone | SEQ ID NO: | VH |
|---|---|---|
| CL-27663 | 1712 | EVQLVQSGSELKKPGASVKVSCKASGYTFTNYRMYWVRQAPGQGL<br>EWMGWINTETGXPAYADDFKRRFVFSLDTSVSTAYLQISSLKAED<br>TAVYYCARTKYYYSSYIFYFDYWGQGTMVTVSS |
| CL-27664 | 1713 | EVQLVQSGSELKKPGASVKVSCKASGYTFTNYSMYWVRQAPGQGL<br>EWMGWINTETGKPTYADDFKGRFVFSLDTSVSTAYLQISSLKAED<br>TAVYYCARTKYYYRFYLFYFDYWGQGTMVTVSS |
| CL-27665 | 1714 | EVQLVQSGSELKKPGASVKVSCKASGYTFTYYGMYWVRQAPGQGL<br>EWMGWINTKTGKPTYADDFKGRFVFSLDTSVSTAYLQISSLKAED<br>TAVYYCARTNYYYGSYIFYFDYWGQGTMVTVSS |
| CL-27666 | 1715 | EVQLVQSGSELKKPGASVKVSCKASGYTFINYRMYWVRQAPGQGL<br>EWMGWINTETGKPVYADDFKGRFVFSLDTSVSTAYLQISSLKAED<br>TAVYYCARTNYYYSSYKFYFDYWGQGTMVTVSS |
| CL-27667 | 1716 | EVQLVQSGSELKKPGASVKVSCKASGYTFTNYAMYWVRQAPGQGL<br>EWMGWINTETGKPTYAQGFTGRFVFSLDTSVSTAYLQISSLKAED<br>TAVYYCARTIYYYXKYIFYFDYWGQGTMVTVSS |
| CL-27668 | 1717 | EVQLVQSGSELKKPGASVKVSCKASGYTFTNYGMYWVRQAPGQGL<br>EWMGWINTETGEPTYAQGFTGRFVFSLDTSVSTAYLQISSLKAED<br>TAVYYCARPTYYYWIYIFYFDYWGQGTMVTVSS |
| CL-27669 | 1718 | EVQLVQSGSELKKPGASVKVSCKASGYTFTNYCMYWVRQAPGQGL<br>EWMGWINTETGKPTYADDFKGRFVFSLDTSVSTAYLQISSLKAED<br>TAVYYCARRNYYYXCYIFYFDYWGQGTMVTVSS |
| CL-27670 | 1719 | EVQLVQSGSELKKPGASVKVSCKASGYTFTTYDMYWVRQAPGQGL<br>EWMGWINTVTGSPAYADDFKGRFVFSLDTSVSTAYLQISSLKAED<br>TAVYYCARTTYYYCSYTFYFDYWGQGTMVTVSS |
| CL-27671 | 1720 | EVQLVQSGSELKKPGASVKVSCKASGYTFTNYGMYWVRQAPGQGL<br>EWMGWINTGTGXPTYAQGFTGRFVFSLDTSVSTAYLQISSLKAED<br>TAVYYCARXNYYYXSYXFYFDYWGQGTMVTVSS |
| CL-27672 | 1721 | EVQLVQSGSELKKPGASVKVSCKASGYTFSKYGMYWVRQAPGQGL<br>EWMGWINTYTGKPLYADDFKGRFVFSLDTSVSTAYLQISSLKAED<br>TAVYYCARTNYYYMGYRFYFDYWGQGTMVTVSS |
| CL-27673 | 1722 | EVQLVQSGSELKKPGASVKVSCKASGYTFTPYGMYWVRQAPGQGL<br>EWMGWINTETGVPSYAQGFTGRFVFSLDTSVSTAYLQISSLKAED<br>TAVYYCARSNYYYRSYRFYFDYWGQGTMVTVSS |
| CL-27674 | 1723 | EVQLVQSGSELKKPGASVKVSCKASGYTFINYVMYWVRQAPGQGL<br>EWMGWINTATGXPSYAQGFTGRFVFSFDTSVSTTYLQISSLKAED<br>TAVYYCARTTYYYRRYIFYFDYWGQGTMVTVSS |
| CL-27675 | 1724 | EVQLVQSGSELKKPGASVKVSCKASGYTFTKYDMYWVRQAPGQGL<br>EWMGWINTATGKPTYADDFKGRFVFSLDTSVSTAYLQISSLKAED<br>TAVYYCARTLYYYRRYIFYFDYWGQGTMVTVSS |
| CL-27676 | 1725 | EVQLVQSGSELKKPGASVKVSCKASGYTFIKYGMYWVRQAPGQGL<br>EWMGWINTETGRPAYADDFKGRFVFSLDTSVSTAYLQISSLKAED<br>TAVYYCARIRYYYGSYIFYFDYWGQGTMVTVSS |
| CL-27677 | 1726 | EVQLVQSGSELKKPGASVKVSCKASGYTFKNYEMYWVRQAPGQGL<br>EWMGWINTETGKPRYADDFKGRFVFSLDTSVNTAYLQISSLKAED<br>TAVYYCARTNYYYRSYVFYFDYWGQGTMVTVSS |
| CL-27678 | 1727 | EVQLVQSGSELKKPGASVKVSCKASGYTFPLYSMYWVRQAPGQGL<br>EWMGWINTHTGNPSYADDFKGRFVFSLDTSVSTAYLQISSLKAED<br>TAVYYCARTNYYYRSYTFYFDYWGQGTMVTVSS |
| CL-27679 | 1728 | EVQLVQSGSELKKPGASVKVSCKASGYTFTNYGMYWVRQAPGQGL<br>EWMGWINTATGKPTYADDFKGRFVFSLDTSVSTAYLQISSLKAED<br>TAVYYCARMNYYYRSYIFYFDYWGQGTMVTVSS |
| CL-27680 | 1729 | EVQLVQSGSELKKPGASVKVSCKASGYTFTNYCMYWVRQAPGQGL<br>EWMGWINTETGKPLYAQGFTGRFVFSLDTSVSTAYLQISSLKAED<br>TAVYYCARRNYYYGGYIFYFDYWGQGTMVTVSS |
| CL-27681 | 1730 | EVQLVQSGSELKKPGASVKVSCKASGYTFTXYGMYWVRQAPGQGL<br>EWMGWINTQTGPPPYADDFKGRFVFSLDTSVSTAYLQISSLKAED<br>TAVYYCARTYYYYRWYIFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-27682 | 1731 | EVQLVQSGSELKKPGASVKVSCKASGYTFTIYEMYWVRQAPGQGL<br>EWMGWINTETGTPPYAXDFTGRFVFSLDTSVSTAYLQISSLKAED<br>TAVYYCARXXYYYXSYIFYFDYWGQGTMVTVSS |
| CL-27683 | 1732 | EVQLVQSGSELKKPGASVKVSCKASGYTFTNYVMYWVRQAPGQGL<br>EWMGWINTDTGNPAYAQGFTGRFVFSLDTSVSTAYLQISSLKAED<br>TAVYYCARTTYYYRVYMFYFDYWGQGTMVTVSS |
| CL-27685 | 1733 | EVQLVQSGSELKKPGASVKVSCKASGYTFTNYCMYWVRQAPGQGL<br>EWMGWINTATGNPSYADDFKGRFVFSLDTSVSTAYLQISSLKAED<br>TAVYYCARTNYYYASYIFYFDYWGQGTMVTVSS |
| CL-27686 | 1734 | EVQLVQSGSELKKPGASVKVSCKASGYTFTNYAMYWVRQAPGQGL<br>EWMGWINTPTGMPNYAQGFTGRFVFSLDTSVSTAYLQISSLKAED<br>TAVYYCARTSYYYSSYLFYFDYWGQGTMVTVSS |
| CL-27687 | 1735 | EVQLVQSGSELKKPGASVKVSCKASGYTFTNYGMYWVRQAPGQGL<br>EWMGWINTDTGTPTYADDFKGRFVFSLDTSVSTAYLQISSLKAED<br>TAVYYCARTEYYYRSYIFYFDYWGQGTMVTVSS |
| CL-27688 | 1736 | EVQLVQSGSELKKPGASVKVSCKASGYTFTNYEMYWVRQAPGQGL<br>EWMGWINTATGKPSYADDFKGRFVFSLDTSVSTAYLQISSLKAED<br>TAVYYCARTIYYYVRYIFYFDYWGQGTMVTVSS |
| CL-27689 | 1737 | EVQLVQSGSELKKPGASVKVSCKASGYTFTNYGMYWVRQAPGQGL<br>EWMGWINTETGTPSYADDFKGRFVFSLDTSVSTAYLQISSLKAED<br>TAVYYCARTVYYYRSYLFYFDYWGQGTMVTVSS |
| CL-27690 | 1738 | EVQLVQSGSELKKPGASVKVSCKASGYTFATYGMYWVRQAPGQGL<br>EWMGWINTETGMPAYADDFKGRFVFSLDTSVSTAYLQISSLKAED<br>TAVYYCARIRYYYGRYLFYFDYWGQGTMVTVSS |
| CL-27691 | 1739 | EVQLVQSGSELKKPGASVKVSCKASGYTFSIYYMYWVRQAPGQGL<br>EWMGWINTGTGTPTYADDFKGRFVFSLDTSVSTAYLQISSLKAED<br>TAVYYCARTSYYYRSYLFYFDYWGQGTMVTVSS |
| CL-27692 | 1740 | EVQLVQSGSELKKPGASVKVSCKASGYTFTNYAMYWVRQAPGQGL<br>EWMGWINTQTGKPRYAQGFTGRFVFSLDTSVSTAYLQISSLKAED<br>TAVYYCARPQYYYTSYIFYFDYWGQGTMVTVSS |
| CL-27694 | 1741 | EVQLVQSGSELKKPGASVKVSCKASGYTFTNYGMYWVRQAPGQGL<br>EWMGWINTXTGXPTYAXDFKGRFVFSLDTSVSTAYLQISSLKAED<br>TAVYYCARXXYYYRSYXFYFDYWGQGTMVTVSS |
| CL-27695 | 1742 | EVQLVQSGSELKKPGASVKVSCKASGYTFTYYNMYWVRQAPGQGL<br>EWMGWINTATGSPTYADDFKGRFVFSLDTSVSTAYLQISSLKAED<br>TAVYYCARSTYYYRSYIFYFDYWGQGTMVTVSS |
| CL-27696 | 1743 | EVQLVQSGSELKKPGASVKVSCKASGYTFTKYGMYWVRQAPGQGL<br>EWMGWINTQTGKPRYADDFKGRFVFSLDTSVSTAYLQISSLKAED<br>TAVYYCARTNYYYWSYIFYFDYWGQGTMVTVSS |
| CL-27697 | 1744 | EVQLVQSGSELKKPGASVKVSCKASGYTFTNYPMYWVRQAPGQGL<br>EWMGWINTETGXPTYADDFKGRFVFSLDTSVSTAYLQISSLKAED<br>TAVYYCARXXYYYXRYIFYFDYWGQGTMVTVSS |
| CL-27699 | 1745 | EVQLVQSGSELKKPGASVKVSCKASGYTFTNYDMYWVRQAPGQGL<br>EWMGWINTATGKPTYADDFKGRFVFSLDTSVSTAYLQISSLKAED<br>TAVYYCARANYYYRSYLFYFDYWGQGTMVTVSS |
| CL-27700 | 1746 | EVQLVQSGSELKKPGASVKVSCKASGYTFAHYGMYWVRQAPGQGL<br>EWMGWINTETGNPDYAQGFTGRFVFSLDTSVSTAYLQISSLKAED<br>TAVYYCARTNYYYRCYIFYFDYWGQGTMVTVSS |
| CL-27701 | 1747 | EVQLVQSGSELKKPGASVKVSCKASGYTFTIYGMYWVRQAPGQGL<br>EWMGWINTETGKPTYAQGFTGRFVFSLDTSVSTAYLQISSLKAED<br>TAVYYCARTNYYYRCYMFYFDYWGQGTMVTVSS |
| CL-27702 | 1748 | EVQLVQSGSELKKPGASVKVSCKASGYTFTNYGMYWVRQAPGQGL<br>EWMGWINTVTGAPIYAQGFTGRFVFSLDTSVSTAYLQISSLKAED<br>TAVYYCARTNYYYWGYRFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-27703 | 1749 | EVQLVQSGSELKKPGASVKVSCKASGYTFRSYVMYWVRQAPGQGL<br>EWMGWINTDTGTPSYAQGFTGRFVFSLDTSVSTAYLQISSLKAED<br>TAVYYCARPYYYYRRYIFYFDYWGQGTMVTVSS |
| CL-27704 | 1750 | EVQLVQSGSELKKPGASVKVSCKASGYTFTNYCMYWVRQAPGQGL<br>EWMGWINTKTGNPAYAQGFTGRFVFSLDTSVSTAYLQISSLKAED<br>TAVYYCARXIYYYRRYVLYFDYWGQGTMVTVSS |
| CL-27705 | 1751 | EVQLVQSGSELKKPGASVKVSCKASGYTFANYSMYWVRQAPGQGL<br>EWMGWINTETGKPKYAQGFTGRFVFSLDTSVSTAYLQISSLKAED<br>TAVYYCARTNYYYRRYSFYFDYWGQGTMVTVSS |
| CL-27706 | 1752 | EVQLVQSGSELKKPGASVKVSCKASGYTFTNYCMYWVRQAPGQGL<br>EWMGWINTTTGKPNYAQGFTGRFVFSLDTSVSTAYLQISSLKAED<br>TAVYYCARSNYYYRRYLFYFDYWGQGTMVTVSS |
| CL-27708 | 1753 | EVQLVQSGSELKKPGASVKVSCKASGYTFTNYGMYWVRQAPGQGL<br>EWMGWINTMTGKPNYAQGFTGRFVFSLDTSVSTAYLQISSLKAED<br>TAVYYCARTDYYYRSYDFYFDYWGQGTMVTVSS |
| CL-27709 | 1754 | EVQLVQSGSELKKPGASVKVSCKASGYTFPKYAMYWVRQAPGQGL<br>EWMGWINTETGXPRYAHDFTGRFVFSLDTSVSTAYLQISSLKAED<br>TAVYYCARTNYYYRGYIFYFDYWGQGTMVTVSS |
| CL-27710 | 1755 | EVQLVQSGSELKKPGASVKVSCKASGYTFSNYVMYWVRQAPGQGL<br>EWMGWINTETGTPMYAQGFTGRFVFSLDTSVSTAYLQISSLKAED<br>TAVYYCARRDYYYRRYVFYFDYWGQGTMVTVSS |
| CL-27711 | 1756 | EVQLVQSGSELKKPGASVKVSCKASGYTFTKYDMYWVRQVPGQGL<br>EWMGWVNTDTGKPPYAQGFTGRFVFSLDTSVSTAYLQISSLKAED<br>TAVYYCARSKYYYWTYVFYFDYWGQGTMVTVSS |
| CL-27712 | 1757 | EVQLVQSGSELKKPGASVKVSCKASGYTFTYYDMYWVRQAPGQGL<br>EWMGWINTXTGKPIYADDFKGRFVFSLDTSVSTAYLQISSLKAED<br>TAVYYCARTIYYYGRYSFYFDYWGQGTMVTVSS |
| CL-27713 | 1758 | EVQLVQSGSELKKPGASVKVSCKASGYTFPFYVMYWVRQAPGQGL<br>EWMGWINTETGKPTYADDFKGRFVFSLDTSVSTAYLQISSLKAED<br>TAVYYCARTNYYYRRYIFYFDYWGQGTMVTVSS |
| CL-27714 | 1759 | EVQLVQSGSELKKPGASVKVSCKASGYTFTTYSMYWVRQAPGQGL<br>EWMGWINTKTGKPTYAQGFTGRFVFSLDTSVSTAYLQISSLKAED<br>TAVYYCARTIYYYMCYVFYFDYWGQGTMVTVSS |
| CL-27715 | 1760 | EVQLVQSGSELKKPGASVKVSCKASGYTFTNYGMYWVRQAPGQGL<br>EWMGWINTETGNPTYAQGFTGRFVFSLDTSVSTAYLQISSLKAED<br>TAVYYCARKHYYYGSYLFYFDYWGQGTMVTVSS |
| CL-27716 | 1761 | EVQLVQSGSELKKPGASVKVSCKASGYTFPDYDMYWVRQAPGQGL<br>EWMGWINTETGMPTYAQGFTGRFVFSLDTSVSTAYLQISSLKAED<br>TAVYYCARTNYYYRGYIFYFDYWGQGTMVTVSS |
| CL-27717 | 1762 | EVQLVQSGSELKKPGASVKVSCKASGYTFTNYGMYWVRQAPGQGL<br>EWMGWINTDTGKPTYAQGFTGRFVFSLDTSVSTAYLQISSLKAED<br>TAVYYCARTYYYYKKYIFYFDYWGQGTMVTVSS |
| CL-27718 | 1763 | EVQLVQSGSELKKPGASVKVSCKASGYTFTNYGMYWVRQAPGQGL<br>EWMGWINTGTGRPTYAQGFTGRFVFSLDTSVSTAYLQISSLKAED<br>TAVYYCARTQYYYRRYIFYFDYWGQGTMVTVSS |
| CL-27719 | 1764 | EVQLVQSGSELKKPGASVKVSCKASGYTFPNYGMYWVRQAPGQGL<br>EWMGWINTKTGKPTYAQGFTGRFVFSLDTSVSTAYLQISSLKAED<br>TAVYYCARKNYYYKSYVFYFDYWGQGTMVTVSS |
| CL-27721 | 1765 | EVQLVQSVSELKKPGASVKVSCKASGYTFTKYTMYWVRQAPGQGL<br>EWMGWINTETGNPMYADDFKGRFVFSLDTSVSTAYLQISSLKAED<br>TAVYYCARTNYYYRIYIFYFDYWGQGTMVTVSS |
| CL-27722 | 1766 | EVQLVQSGSELKKPGASVKVSCKASGYTFTNYGMYWVRQAPGQGL<br>EWMGWINTATGKPTYADDFKGRFVFSLDTSVSTAYLQISSLKAED<br>TAVYYCARSSYYYRNYIFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-27723 | 1767 | EVQLVQSGSELKKPGASVKVSCKASGYTFTNYGMYWVRQAPGQGL<br>EWMGWINTVTGKPDYADDFKGRFVFSLDTSVSTAYLQISSLKAED<br>TAVYYCARQKYYYRSYFFYFDYWGQGTMVTVSS |
| CL-27725 | 1768 | EVQLVQSGSELKKPGASVKVSCKASGYTFTNYDMYWVRQAPGQGL<br>EWMGWINTDTGKPAYADDFKGRFVFSLDTSVSTAYLQISSLKAED<br>TAVYYCARPSYYYVXYIFYFDYWGQGTMVTVSS |
| CL-27726 | 1769 | EVQLVQSGSELKKPGASVKVSCKASGYTFTLYXMYWVRQAPGQGL<br>EWMGWINTATGKPTYAHDFTGRFVFSLDTSVSTAYLQISSLKAED<br>TAVYYCARTXYYYRSYIFYFDYWGQGTMVTVSS |
| CL-27727 | 1770 | EVQLVQSGSELKKPGASVKVSCKASGYTFTKYGMYWVRQAPGQGL<br>EWMGWINTHTGNPTYADDFKGRFVFSLDTSVSTAYLQISSLKAED<br>TAVYYCARTNYYYRCYIFYFDYWGQGTMVTVSS |
| CL-27728 | 1771 | EVQLVQSGSELKKPGASVKVSCKASGYTFTNYGMYWVRQAPGQGL<br>EWMGWINTETGKPEYADDFKGRFVFSLDTSVSTAYLQISSLKAED<br>TAVYYCARPNYYYRSYFFYFDYWGQGTMVTVSS |
| CL-27729 | 1772 | EVQLVQSGSELKKPGASVKVSCKASGYTFTDYGMYWVRQAPGQGL<br>EWMGWINTETGRPGYAQGFTGRFVFSLDTSVSTAYLQISSLKAED<br>TAVYYCARLWYYYWMYIFYFDYWGQGTMVTVSS |
| CL-27730 | 1773 | EVQLVQSGSELKKPGASVKVSCKASGYTFTYYGMYWVRQAPGQGL<br>EWMGWINTETGTPTYAQGFTGRFVFSLDTSVSTAYLQISSLKAED<br>TAVYYCARVYYYYGSYSFYFDYWGQGTMVTVSS |
| CL-27731 | 1774 | EVQLVQSGSELKKPGASVKVSCKASGYTFVNYAMYWVRQAPGQGL<br>EWMGWINTXTGKPTYADDFKGRFVFSLDTSVSTAYLQISSLKAED<br>TAVYYCARKTYYYRGYIFYFDYWGQGTMVTVSS |
| CL-27733 | 1775 | EVQLVQSGSELKKPGASVKVSCKASGYTFTHYYMYWVRQAPGQGL<br>EWMGWINTETGKPTYADDFKGRFVFSLDTSVSTAYLQISSLKAED<br>TAVYYCARSKYYYRSYTFYFDYWGQGTMVTVSS |
| CL-27734 | 1776 | EVQLVQSGSELKKPGASVKVSCKASGYTFLHYGMYWVRQAPGQGL<br>EWMGWINTETGWPRYAQGFTGRFVFSLDTSVSTAYLQISSLKAED<br>TAVYYCARTSYYYVSYIFYFDYWGQGTMVTVSS |
| CL-27735 | 1777 | EVQLVQSGSELKKPGASVKVSCKASGYTFTIYGMYWVRQAPGQGL<br>EWMGWINTATGKPTYADDFKGRFVFSLDTSVSTAYLQISSLKAED<br>TAVYYCARTXYYYRSYVFYFDYWGQGTMVTVSS |
| CL-27736 | 1778 | EVQLVQSGSELKKPGASVKVSCKASGYTFTNYGMYWVRQAPGQGL<br>EWMGWINTETGNPIYAQGFTGRFVFSLDTSVSTAYLQISSLKAED<br>TAVYYCARAHYYYRTYXFYFDYWGQGTMVTVSS |
| CL-27737 | 1779 | EVQLVQSGSELKKPGASVKVSCKASGYTFTNYGMYWVRQAPGQGL<br>EWMGWINTETGNPIYAQGFTGRFVFSLDTSVSTAYLQISSLKAED<br>TAVYYCARAHYYYRTYNFYFDYWGQGTMVTVSS |
| CL-27738 | 1780 | EVQLVQSGSELKKPGASVKVSCKASGYTFSNYWMYWVRQAPGQGL<br>EWMGWINTETGRPRYADDFKGRFVFSLDTSVSTAYLQISSLKAED<br>TAVYYCARVYYYYRCYSFYFDYWGQGTMVTVSS |
| CL-27739 | 1781 | EVQLVQSGSELKKPGASVKVSCKASGYTFTHYWMYWVRQAPGQGL<br>EWMGWINTETGTPSYAQGFTGRFVFSLDTSVSTAYLQISSLKAED<br>TAVYYCARTTYYYRSYIFYFDYWGQGTMVTVSS |
| CL-27741 | 1782 | EVQLVQSGSELKKPGASVKVSCKASGYTFTKYGMYWVRQAPGQGL<br>EWMGWINTNTGKPTYAQGFTGRFVFSLDTSVSTAYLQISSLKAED<br>TAVYYCARAYYYYWSYIFYFDYWGQGTMVTVSS |
| CL-27742 | 1783 | EVQLVQSGSELKKPGASVKVSCKASGYTFTSYVMYWVRQAPGQGL<br>EWMGWINTKTGMPTYADDFKGRFVFSLDTSVSTAYLQISSLKAED<br>TAVYYCARTTYYYMSYIFYFDYWGQGTMVTVSS |
| CL-27744 | 1784 | EVQLVQSGSELKKPGASVKVSCKASGYTFTQYGMYWVRQAPGQGL<br>EWMGWINTETGKPKYAQGFTGRFVFSLDTSVSTAYLQISSLKAED<br>TAVYYCARTNYYYWSYKFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-27747 | 1785 | EVQLVQSGSELKKPGASVKVSCKASGYTFSTYMMYWVRQAPGQGL EWMGWINTETGXPTYADDFKGRFVFSLDTSVSTAYLQISSLKAED TAVYYCARSNYYYRSYIFYFDYWGQGTMVTVSS |
| CL-27750 | 1786 | EVQLVQSGSELKKPGASVKVSCKASGYTFMNYVMYWVRQAPGQGL EWMGWINTKTGMPRYAQGFTGRFVFSLDTSVSTAYLQISSLKAED TAVYYCARTNYYYMRYIFYFDYWGQGTMVTVSS |
| CL-27751 | 1787 | EVQLVQSGSELKKPGASVKVSCKASGYTFTTYGMYWVRQAPGQGL EWMGWINTQTGEPPYAQGFTGRFVFSLDTSVSTAYLQISSLKAED TAVYYCARTGYYYWNLFYFDYWGQGTMVTVSS |
| CL-27752 | 1788 | EVQLVQSGSELKKPGASVKVSCKASGYTFTNYRMYWVRQAPGQGL EWMGWINTETGKPPYADDFKGRFVFSLDTSVSTAYLQISSLKAED TAVYYCARTNYYYMSYIFYFDYWGQGTMVTVSS |
| CL-27753 | 1789 | EVQLVQSGSELKKPGASVKVSCKASGYTFTNYGMYWVRQAPGQGL EWMGWINTETGSPRYAQGFTGRFVFSLDTSVSTAYLQISSLKAED TAVYYCARTNYYYVSYIFYFDYWGQGTMVTVSS |
| CL-27755 | 1790 | EVQLVQSGSELKKPGASVKVSCKASGYTFTNYGMYWVRQAPGQGL EWMGWINTETGXPTYAHDFTGRFVFSLDTSVSTAYLQISSLKAED TAVYYCARXNYYYXXYIFYFDYWGQGTMVTVSS |
| CL-27756 | 1791 | EVQLVQSGSELKKPGASVKVSCKASGYTFTIYGMYWVRQAPGQGL EWMGWINTDTGRPIYAQGFTGRFVFSLDTSVSTAYLQISSLKAED TAVYYCARIIYYYCSYIFYFDYWGQGTMVTVSS |
| CL-27757 | 1792 | EVQLVQSGSELKKPGASVKVSCKASGYTFNNYGMYWVRQAPGQGL EWMGWINTETGKPTYAQGFTGRFVFSLDTSVSTAYLQISSLKAED TAVYYCARTNYYYRSYIFYFDYWGQGTMVTVSS |
| CL-27758 | 1793 | EVQLVQSGSELKKPGASVKVSCKASGYTFSLYAMYWVRQAPGQGL EWMGWINTETGKPTYADDFKQFVFSLDTSVSTAYLQISSLKAED TAVYYCARTNYYYRSYNFYFDYWGQGTMVTVSS |
| CL-27760 | 1794 | EVQLVQSGSELKKPGASVKVSCKASGYTFTNYGMYWVRQAPGQGL EWMGWINTETGKPTYADDFKGRFVFSLDTSVSTAYLQISSLKAED TAVYYCARTNYYYRSYIFYFDYWGQGTMVTVSS |
| CL-27824 | 1795 | EVQLVQSGSELNXPGASLKVSCKASGYTFXNYGXYWVRQAPGQGL EWMGWINTETGKPTYADDFKGRFVFSLDTSVSTAYLQISSLKAED TAVYYCARTNYYYRSYIFYFDYWGQGTMVTVSS |
| CL-27833 | 1796 | EVQLVQSGSELKKPGASVKVSCKASGYTFTNYGIYWVRQAPGQGL EWMGWINTETGKPTYADDFKGRFVFSLDTSVSTAYLQISSLKAED TAVYYCARTNYYYRSYIFYFDYWGQGTMVTVSS |
| CL-29884 | 1797 | EVQLVQSGSELKKPGASVKVSCKASGYTFTDYGMYWVRQAPGQGL EWMGWINTETGEPTYADDFKGRFVFSLDTSVSTAYLQISSLKAED TAVYYCARTNYYYRLYMFYFDYWGQGTMVTVSS |
| CL-29885 | 1798 | EVQLVQSGSELKKPGASVKVSCKASGYTFTDYGMYWVRQAPGQGL EWMGWINTETGEPTYADDFKGRFVFSLDTSVSTAYLQISSLKAED TAVYYCARTNYYYQSYMFYFDYWGQGTMVTVSS |
| CL-29887 | 1799 | EVQLVQSGSELKKPGASVKVSCKASGYTFPNYGMYWVRQAPGQGL EWMGWINTETGEPSYADDFKGRFVFSLDTSVSTAYLQISSLKAED TAVYYCARTNYYYPSYMFYFDYWGQGTMVTVSS |
| CL-29888 | 1800 | EVQLVQSGSELKKPGASVKVSCKASGYTFTDYGMYWVRQAPGQGL EWMGWINTETGEPTYAQGFTGRFVFSLDTSVSTAYLQISSLKAED TAVYYCARANYYYRTYMFYFDYWGQGTMVTVSS |
| CL-29889 | 1801 | EVQLVQSGSELKKPGASVKVSCKASGYTFADYGMYWVRQAPGQGL EWMGWINTETGEPTYADDFKGRFVFSLDTSVSTAYLQISSLKAED TAVYYCARSNYYYRTYMFYFDYWGQGTMVTVSS |
| CL-29890 | 1802 | EVQLVQSGSELKKPGASVKVSCKASGYTFTTYGMYWVRQAPGQGL EWMGWINTETGXPTYAXDFKGRFVFSLDTSVSTAYLQISSLKAED TAVYYCARRXYYYXSYXFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-29891 | 1803 | EVQLVQSGSELKKPGASVKVSCKASGYTFPNYGMYWVRQAPGQGL EWMGWINTETGEPTYADDFKGRFVFSLDTSVSTAYLQISSLKAED TAVYYCARTNYYYPSYMFYFDYWGQGTMVTVSS |
| CL-29892 | 1804 | EVQLVQSGSELKKPGASVKVSCKASGYTFSNYGMYWVRQAPGQGL EWMGWINTETGQPTYAQGFTGRFVFSLDTSVSTAYLQISSLKAED TAVYYCARTNYYYPSYMFYFDYWGQGTMVTVSS |
| CL-29893 | 1805 | EVQLVQSGSELKKPGASVKVSCKASGYTFTNYGMYWVRQAPGQGL EWMGWIDTETGEPTYADDFKGRFVFSLDTSVSTAYLQISSLKAED TAVYYCARVNYYYRNYMFYFDYWGQGTMVTVSS |
| CL-29895 | 1806 | EVQLVQSGSELKKPGASVKVSCKASGYTFSDYGMYWVRQAPGQGL EWMGWINTETGEPTYADDFKGRFVFSLDTSVSTAYLQISSLKAED TAVYYCARVNYYYMSYMFYFDYWGQGTMVTVSS |
| CL-29896 | 1807 | EVQLVQSGSELKKPGASVKVSCKASGYTFTDYGMYWVRQAPGQGL EWMGWINTETGEPTYAQGFTGRFVFSLDTSVSTAYLQISSLKAED TAVYYCARTNYYYRMYMFYFDYWGQGTMVTVSS |
| CL-29897 | 1808 | EVQLVQSGSELKKPGASVKVSCKASGYTFLNYGMYWVRQAPGQGL EWMGWINTETGKPTYAQGFTGRFVFSLDTSVSTAYLQISSLKAED TAVYYCARTKYYYWRYIFYFDYWGQGTMVTVSS |
| CL-29898 | 1809 | EVQLVQSGSELKKPGASVKVSCKASGYTFNDYGMYWVRQAPGQGL EWMGWINTETGEPTYADDFKGRFVFSLDTSVSTAYLQISSLKAED TAVYYCARTNYYYRSYMFYFDYWGQGTMVTVSS |
| CL-29899 | 1810 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARINYYYRSYMFYFDYWGQGTMVTVSS |
| CL-29901 | 1811 | EVQLVQSGSELKKPGASVKVSCKASGYTFMNYGMYWVRQAPGQGL EWMGWIDTETGXXXYAHDFTGRFVFSLDTSVSTAYLEISSLKAED TAVYYCARXNYYYXXYMFYFDYWGQGTMVTVSS |
| CL-29902 | 1812 | EVQLVQSGSELKKPGASVKVSCKASGYTFTSYGMYWVRQAPGQGL EWMGWINTETGQPMYADDFKGRFVFSLDTSVSTAYLQISSLKAED TAVYYCARRIYYYRCYLFYFDYWGQGTMVTVSS |
| CL-29904 | 1813 | EVQLVQSGSELKKPGASVKVSCKASGYTFTNYGMYWVRQAPGQGL EWMGWIDTDTGMPTYADDFKGRFVFSLDTSVSTAYLQISSLKAED TAVYYCARANYYYRSYMFYFDYWGQGTMVTVSS |
| CL-29906 | 1814 | EVQLVQSGSELKKPGASVKVSCKASGYTFNNYGMYWVRQAPGQGL EWMGWINTETGEPTYADDFKGRFVFSLDTSVSTAYLQISSLKAED TAVYYCARTNYYYRNYMFYFDYWGQGTMVTVSS |
| CL-29907 | 1815 | EVQLVQSGSELKKPGASVKVSCKASGYTFTDYGMYWVRQAPGQGL EWMGWINTETGEPSYADDFKGRFVFSLDTSVSTAYLQISSLKAED TAVYYCARSNYYYRSYMFYFDYWGQGTMVTVSS |
| CL-29908 | 1816 | EVQLVQSGSELKKPGASVKVSCKASGYTFSNYGMYWVRQAPGQGL EWMGWINTETGEPTYADDFKGRFVFSLDTSVSTAYLQISSLKAED TAVYYCARTNYYYKSYMFYFDYWGQGTMVTVSS |
| CL-29909 | 1817 | EVQLVQSGSELKKPGASVKVSCKASGYTFTNYGMYWVRQAPGQGL EWMGWINTETGEPTYADDFKGRFVFSLDTSVSTAYLQISSLKAED TAVYYCARANYYYRSYMFYFDYWGQGTMVTVSS |
| CL-29910 | 1818 | EVQLVQSGSELKKPGASVKVSCKASGYTFNYYGMYWVRQAPGQRL EWMGWINTETGEPTYADDFKGRFVFSLDTSVSTAYLQISSLKAED TAVYYCARTNYYYESYMFYFDYWGQGTMVTVSS |
| CL-29912 | 1819 | EVQLVQSGSELKKPGASVKVSCKASGYTFTDYGMYWVRQAPGQGL EWMGWINTDTGEPTYADDFKGRFVFSLDTSVSTAYLQISSLKAED TAVYYCARTNYYYRSYMFYFDYWGQGTMVTVSS |
| CL-29913 | 1820 | EVQLVQSGSELKKPGASVKVSCKASGYTFTKYRMYWVRQAPGQGL EWMGWINTVTGKPKYADDFTGRFVFSLDTSVSTAYLQISSLKAED TAVYYCARFKYYYGSYFFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-29914 | 1821 | EVQLVQSGSELKKPGASVKVSCKASGYTFTNYGMYWVRQAPGQGL EWMGWINTETGQPTYADDFKGRFVFSLDTSVSTAYLQISSLKAED TAVYYCARTNYYYPSYMFYFDYWGQGTMVTVSS |
| CL-29915 | 1822 | EVQLVQSGSELKKPGASVKVSCKASGYTFTNYGMYWVRQAPGQGL EWMGWIDTETGEPTYAQGFTGRFVFSLDTSVSTAYLQISSLKAED TAVYYCARTNYYYRNYMFYFDYWGQGTMVTVSS |
| CL-29916 | 1823 | EVQLVQSGSELKKPGASVKVSCKASGYTFTDYGMYWVRQAPGQGL EWMGWINTETGDPTYADDFKGRFVFSLDTSVSTAYLQISSLKAED TAVYYCARTNYYYRSYMFYFDYWGQGTMVTVSS |
| CL-29917 | 1824 | EVQLVQSGSELKKPGASVKVSCKASGYTFNNYGMYWVRQAPGQGL EWMGWIDTETGQPTYADDFKGRFVFSLDTSVSTAYLQISSLKAED TAVYYCARTNYYYPRYMFYFDYWGQGTMVTVSS |
| CL-29918 | 1825 | EVQLVQSGSELKKPGASVKVSCKASGYTFSNYGMYWVRQAPGQGL EWMGWINTDTGEPTYAQGFTGRFVFSLDTSVSTAYLQISSLKAED TAVYYCARTNYYYASYMFYFDYWGQGTMVTVSS |
| CL-29919 | 1826 | EVQLVQSGSELKKPGASVKVSCKASGYTFTNYGMYWVRQAPGQGL EWMGWIDTETGEPTYADDFKGRFVFSLDTSVSTAYLQISSLKAED TAVYYCARTNYYYQSYMFYFDYWGQGTMVTVSS |
| CL-29921 | 1827 | EVQLVQSGSELKKPGASVKVSCKASGYTFSHYGMYWVRQAPGQGL EWMGWINTETGSPTYADDFKGRFVFSLDTSVSTAYLQISSLKAED TAVYYCARTNYYYPSYMFYFDYWGQGTMVTVSS |
| CL-29922 | 1828 | EVQLVQSGSELKKPGASVKVSCKASGYTFTNYGMYWVRQAPGQGL EWMGWINTDTGEPTYADDFKGRFVFSLDTSVSTAYLQISSLKAED TAVYYCARTNYYYPSYMFYFDYWGQGTMVTVSS |
| CL-29924 | 1829 | EVQLVQSGSELKKPGASVKVSCKASGYTFTDYGMYWVRQAPGQGL EWMGWINTETGNPTYADDFKGRFVFSLDTSVSTAYLQISSLKAED TAVYYCARTNYYYRSYMFYFDYWGQGTMVTVSS |
| CL-29925 | 1830 | EVQLVQSGSELKKPGASVKVSCKASGYTFSNYGMYWVRQAPGQGL EWMGWINTETGEPTYAXGFTGRFVFSLDTSVSTAYLQISSLKAED TAVYYCARTNYYYRSYMFYFDYWGQGTMVTVSS |
| CL-29926 | 1831 | EVQLVQSGSELKKPGASVKVSCKASGYTFSNYGMYWVRQAPGQGL EWMGWIDTETGEPTYADDFKGRFVFSLDTSVSTAYLQISSLKAED TAVYYCARSNYYYTSYMFYFDYWGQGTMVTVSS |
| CL-29927 | 1832 | EVQLVQSGSELKKPGASVKVSCKASGYTFTDYGMYWVRQAPGQGL EWMGWINTETGQPTYADDFKGRFVFSLDTSVSTAYLQISSLKAED TAVYYCARTNYYYRMYMFYFDYWGQGTMVTVSS |
| CL-29928 | 1833 | EVQLVQSGSELKKPGASVKVSCKASGYTFTNYGMYWVRQAPGQGL EWMGWINTETGEPYYADDFKGRFVFSLDTSVSTAYLQISSLKAED TAVYYCARTNYYYPKYMFYFDYWGQGTMVTVSS |
| CL-29929 | 1834 | EVQLVQSGSELKKPGASVKVSCKASGYTFTHYWMYWVRQAPGQGL EWMGWINTETGKPAYADDFKGRFVFSLDTSVSTAYLQISSLKAED TAVYYCARTNYYYIYYLFYFDYWGQGTMVTVSS |
| CL-29931 | 1835 | EVQLVQSGSELKKPGASVKVSCKASGYTFPNYGMYWVRQAPGQGL EWMGWINTGTGKPTYAQGFTGRFVFSLDTSVSTAYLQISSLKAED TAVYYCARTNYYYRNYMFYFDYWGQGTMVTVSS |
| CL-29932 | 1836 | EVQLVQSGSELKKPGASVKVSCKASGYTFTPYGMYWVRQAPGQGL EWMGWINTDTGXPPYADDFKGRFVFSLDTSVSTAYLQISSLKAED TAVYYCARTNYYYTCYIFYFDYWGQGTMVTVSS |
| CL-29934 | 1837 | EVQLVQSGSELKKPGASVKVSCKASGYTFTHYGMYWVRQAPGQGL EWMGWINTETGXPTYADDFKGRFVFSLDTSVSTAYLQISSLKAED TAVYYCARTNYYYPRYMFYFDYWGQGTMVTVSS |
| CL-29935 | 1838 | EVQLVQSGSELKKPGASVKVSCKASGYTFPDYGMYWVRQAPGQGL EWMGWIDTETGMPXYADDFKGRFVFSLDTSVSTAYLQISSLKAED TAVYYCARTNYYYRNYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-29936 | 1839 | EVQLVQSGSELKKPGASVKVSCKASGYTFTNYGMYWVRQAPGQGL EWMGWINTETGEPTYADDFKGRFVFSLDTSVSTAYLQISSLKAED TAVYYCARTNYYYRSYMFYFDYWGQGTMVTVSS |
| CL-29937 | 1840 | EVQLVQSGSELKKPGASVKVSCKASGYTFTNYGMYWVRQAPGQGL EWMGWINTETGDPTYADDFKGRFVFSLDTSVSTAYLQISSLKAED TAVYYCARXNYYYRXYMFYFDYWGQGTMVTVSS |
| CL-29938 | 1841 | EVQLVQSGSELKKPGASVKVSCKASGYTFNKYDMYWVRQAPGQGL EWMGWINTKTGKPTYAQGFTGRFVFSLDTSVSTAYLQISSLKAED TAVYYCARTAYYYRNYKSTLITGGQGTMVTVSS |
| CL-29939 | 1842 | EVQLVQSGSELKKPGASVKVSCKASGYTFTNYGMYWVRQAPGQGL EWMGWINTETGEPTYADDFKGRFVFSLDTSVSTAYLQISSLKAED TAVYYCARTNYYYKGYMFYFDYWGQGTMVTVSS |
| CL-29940 | 1843 | EVQLVQSGSELKKPGASVKVSCKASGYTFTNYGMYWVRQAPGQGL EWMGWINTETGTPTYADDFKGRFVFSLDTSVSTAYLQISSLKAED TAVYYCARTYYYYRTYIFYFDYWGQGTMVTVSS |
| CL-29941 | 1844 | EVQLVQSGSELKKPGASVKVSCKASGYTFSNYGMYWVRQAPGQGL EWMGWINTETGEPTYADDFKGRFVFSLDTSVSTAYLQISSLKAED TAVYYCARTNYYYRGYMFYFDYWGQGTMVTVSS |
| CL-29942 | 1845 | EVQLVQSGSELKKPGASVKVSCKASGYNFTKYEMYWVRQAPGQGL EWMGWINTETGNPTYADDFKGRFVFSLDTSVSTAYLQISSLKAED TAVYYCARTKYYYRSYVFYFDYWGQGTMVTVSS |
| CL-29943 | 1846 | EVQLVQSGSELKKPGASVKVSCKASGYTFPNYGMYWVRQAPGQGL EWMGWIDTETGEPTYADDFKGRFVFSLDTSVSTAYLQISSLKAED TAVYYCARTNYYYLSYMFYFDYWGQGTMVTVSS |
| CL-29946 | 1847 | EVQLVQSGSELKKPGASVKVSCKASGYTFTHYGMYWVRQAPGQGL EWMGWINTETGEPTYAQGFTGRFVFSLDTSVSTAYLQISSLKAED TAVYYCARTNYYYPSYMFYFDYWGQGTMVTVSS |
| CL-29947 | 1848 | EVQLVQSGSELKKPGASVKVSCKASGYTFTDYGMYWVRQAPGQGL EWMGWINTDTGDPTYADDFKGRFVFSLDTSVSTAYLQISSLKAED TAVYYCARANYYYRTYMFYFDYWGQGTMVTVSS |
| CL-29948 | 1849 | EVQLVQSGSELKKPGASVKVSCKASGYTFTNYGMYWVRQAPGQGL EWMGWIDTETGTPTYADDFKGRFVFSLDTSVSTAYLQISSLKAED TAVYYCARTNYYYPSYMFYFDYWGQGTMVTVSS |
| CL-29949 | 1850 | EVQLVQSGSELKKPGASVKVSCKASGYTFTNYGMYWVRQAPGQGL EWMGWIDTETGDPTYADDFKGRFVFSLDTSVSTAYLQISSLKAED TAVYYCARVNYYYRSYMFYFDYWGQGTMVTVSS |
| CL-29950 | 1851 | EVQLVQSGSELKKPGASVKVSCKASGYTFTDYGMYWVRQAPGQGL EWMGWIDTQTGEPTYADDFKGRFVFSLDTSVSTAYLQISSLKAED TAVYYCARSNYYYRLYMFYFDYWGQGTMVTVSS |
| CL-29951 | 1852 | EVQLVQSGSELKKPGASVKVSCKASGYTFPDYGMYWVRQAPGQGL EWMGWIDTETGQPTYADDFKGRFVFSLDTSVSTAYLQISSLKAED TAVYYCARADYYYPTYMFYFDYWGQGTMVTVSS |
| CL-29952 | 1853 | EVQLVQSGSELKKPGASVKVSCKASGYTFTHYGMYWVRQAPGQGL EWMGWINTETGEPTYADDFKGRFVFSLDTSVSTAYLQISSLKAED TAVYYCARTNYYYPTYMFYFDYWGQGTMVTVSS |
| CL-29955 | 1854 | EVQLVQSGSELKKPGASVKVSCKASGYTFSNYGMYWVRQAPGQGL EWMGWIDTETGEPTYADDFKGRFVFSLDTSVSTAYLQISSLKAED TAVYYCARSNYYYRSYMFYFDYWGQGTMVTVSS |
| CL-29957 | 1855 | EVQLVQSGSELKKPGASVKVSCKASGYTFTNYGMYWVRQAPGQGL EWMGWINTVTGQPTYADDFKGRFVFSLDTSVSTAYLQISSLKAED TAVYYCARTHYYYRTYLFYFDYWGQGTMVTVSS |
| CL-29958 | 1856 | EVQLVQSGSELKKPGASVKVSCKASGYTFPNYGMYWVRQAPGQGL EWMGWINTETGEPTYADDFKGRFVFSLDTSVSTAYLQISSLKAED TAVYYCARTNYYYRSYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-29959 | 1857 | EVQLVQSGSELKKPGASVKVSCKASGYTFTNYGMYWVRQAPGQGL<br>EWMGWINTETGEPTYADDFKGRFVFSLDTSVSTAYLQISSLKAED<br>TAVYYCARTNYYYRGYMFYFDYWGQGTMVTVSS |
| CL-29960 | 1858 | EVQLVQSGSELKKPGASVKVSCKASGYTFTNYSMYWVRQAPGQGL<br>EWMGWINTXTGKPIYAQGFTGRFVFSLDTSVSTAYLQISSLKAED<br>TAVYYCARTKYYYRTYRFYFDYWGQGTMVTVSS |
| CL-29961 | 1859 | EVQLVQSGSELKKPGASVKVSCKASGYTFSNYGMYWVRQAPGQGL<br>EWMGWIDTETGTPVYADDFKGRFVFSLDTSVNTAYLQISSLKAED<br>TAVYYCARTNYYYKSYMFYFDYWGQGTMVTVSS |
| CL-29962 | 1860 | EVQLVQSGSELKKPGASVKVSCKASGYTFSNYGMYWVRQAPGQGL<br>EWMGWIDTETGEPTYADDFTGRFVFSLDTSVSTAYLQISSLKAED<br>TAVYYCARSNYYYSSYMFYFDYWGQGTMVTVSS |
| CL-29963 | 1861 | EVQLVQSGSELKKPGASVKVSCKASGYTFSEYGMYWVRQAPGQGL<br>EWMGWINTETGEPTYADDFKGRFVFSLDTSVSTAYLQISSLKAED<br>TAVYYCARTNYYYRSYMFYFDYWGQGTMVTVSS |
| CL-29966 | 1862 | EVQLVQSGSELKKPGASVKVSCKASGYTFTNYGMYWVRQAPGQGL<br>EWMGWIDTETGKPTYADDFKGRFVFSLDTSVSTAYLQISSLKAED<br>TAVYYCARVNYYYRWYMFYFDYWGQGTMVTVSS |
| CL-29967 | 1863 | EVQLVQSGSELKKPGASVKVSCKASGYTFPNYGMYWVRQAPGQGL<br>EWMGWINTETGEPTYAQGFTGRFVFSLDTSVSTAYLQISSLKAED<br>TAVYYCARTNYYYPSYMFYFDYWGQGTMVTVSS |
| CL-29968 | 1864 | EVQLVQSGSELKKPGASVKVSCKAYGYTFTDYGMYWVRQAPGQGL<br>EWMGWINTETGEPTYAQGFTGRFVFSLDTSVSTAYLQISSLKAED<br>TAVYYCARTNYYYEKYMFYFDYWGQGTMVTVSS |
| CL-29969 | 1865 | EVQLVQSGSELKKPGASVKVSCKASGYTFTDYGMYWVRQAPGQGL<br>EWMGWIDTETGEPTYADDFKGRFVFSLDTSVSTAYLQISSLKAED<br>TAVYYCARSNYYYRGYMFYFDYWGQGTMVTVSS |
| CL-29970 | 1866 | EVQLVQSGSELKKPGASVKVSCKASGYTFMTYVMYWVRQAPGQGL<br>EWMGWINTETGKPSYAHDFTGRFVFSLDTSVSTAYLQISSLKAED<br>TAVYYCARMXYYYXIYMFYFDYWGQGTMVTVSS |
| CL-29971 | 1867 | EVQLVQSGSELKKPGASVKVSCKASGYTFSNYGMYWVRQAPGQGL<br>EWMGWINTETGEPTYADDFKGRFVFSLDTSVSTAYLQISSLKAED<br>TAVYYCARTNYYYRSYMFYFDYWGQGTMVTVSS |
| CL-29972 | 1868 | EVQLVQSGSELKKPGASVKVSCNASGXTFTNYGMYWVRQAPGQGL<br>EWMGWINTETGKPTYAQGFTGRFVFSLDTSVSTAYLQISSLKAED<br>TAVYYCARINYYYRSYIFYFDYWGQGTMVTVSS |
| CL-29973 | 1869 | EVQLVQSGSELKKPGASVKVSCKASGYTFNDYGMYWVRQAPGQGL<br>EWMGWINTETGEPTYAXXFTGRFVFSLDTSVSTAYLQISSLKAED<br>TAVYYCARTNYYYEGYMFYFDYWGQGTMVTVSS |
| CL-29974 | 1870 | EVQLVQSGSELKKPGASVKVSCKASGYTFSDYGMYWVRQAPGQGL<br>EWMGWINTETGEPTYADDFKGRFVFSLDTSVSTAYLQISSLKAED<br>TAVYYCARTNYYYRSYMFYFDYWGQGTMVTVSS |
| CL-29975 | 1871 | EVQLVQSGSELKKPGASVKVSCKASGYTFTNYGMYWVRQAPGQGL<br>EWMGWINTETGEPTYAQGFTGRFVFSLDTSVSTAYLQISSLKAED<br>TAVYYCARTNYYYKSYMFYFDYWGQGTMVTVSS |
| CL-29976 | 1872 | EVQLVQSGSELRKPGASVKVSCKASGYTFNNYGMYWVRQAPGQGL<br>EWMGWIDTETGRPWYADDFKGRFVFSLDTSVSTAYLQISSLKAED<br>TAVYYCARTNYYYQGYMFYFDYWGQGTMVTVSS |
| CL-29980 | 1873 | EVQLVQSGSELKKPGASVKVSCKASGYTFTNYGMHWVRQAPGQGL<br>EWMGWINTETGKPTYADDFKGRFVFSLDTSVSTAYLQISSLKAED<br>TAVYYCARTNYYYRSYIFYFDYWGQGTMVTVSS |
| CL-30036 | 1874 | EVQLVQSGSELKKPGASVKVSCKASGYTFTNYGMYWVRQAPGQGL<br>EWMGWINTETGKPTYADDFKGRFVFSLDTSVSTAYLQISSLKAED<br>TAVYYCARTNYYYRSHIFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-30060 | 1875 | EVQLVQSGSELKKPGASVRVSCKASGYTFTNYGMYWVRQAPGQGL<br>EWMGWINTETGKPTYADDFKGRFVFSLDTSVSTAYLQISSLKAED<br>TAVYYCARTNYYYRSYIFYFDYWGQGTMVTVSS |
| CL-30075 | 1876 | EVQLVQSGSELKKPGASVKVSCKASGYTFTNYGMYWVRQAPGQGL<br>EWMGWINTXTGKPTYAXGFTGRFVFSLDTSVSTAYLQIXXLXAXD<br>TAVYYCARXKYYYXSYIFYFDYWGQGTMVTVSS |
| CL-30076 | 1877 | EVQLVQSGSELKKPGASVKVSCKASGYTFYNYCMYWVRQAPGQGL<br>EWMGWINTETGIPKYAQGFTGRFVFSLDTSVSTAYLQISSLKAED<br>TAVYYCARINYYYKRYIFYFDYWGQGTMVTVSS |
| CL-30077 | 1878 | EVQLVQSGSELKKPGASVKVSCKASGYTFTDYYMYWVRQAPGQGL<br>EWMGWINTETGKPTYADDFKGRFVFSLDTSVSTAYLQISSLKAED<br>TAVYYCARTXYYYXRYXFYFDYWGQGTMVTVSS |
| CL-30078 | 1879 | EVQLVQSGSELKKPGASVKVSCKASGYTFTNYGMYWVRQAPGQGL<br>EWMGWINTETGKPTYADDFKGRFVFSLDTSVSTAYLQISSLKAED<br>TAVYYCARTNYYYRSYIFYFDYWGQGTMVTVFS |
| CL-30079 | 1880 | EVQLVQSGSELKKPGASVKVSCKASGYTFIHYGMYWVRQAPGQGL<br>EWMGWINTETGRPTYADDFKGRFVFSLDTSVSTAYLQISSLKXED<br>TAVYYCARTVYYYPRYTFYFDYWGQGTMVTVSS |
| CL-30082 | 1881 | EVQLVQSGSELKKPGASVKVSCKASGYTFMNYGMYWVRQAPGQGL<br>EWMGWINTETGKPTYAQGFTGRFVFSLDTSVSTAYLQISSLKAED<br>TAVYYCARTNYYYPGYIFYFDYWGQGTMVTVSS |
| CL-30083 | 1882 | EVQLVQSGSELKKPGASVKVSCKASGYTFTLYGMYWVRQAPGQGL<br>EWMGWINTDTGKPTYADDFKGRFVFSLDTSVSTAYLQISSLKAED<br>TAVYYCARTNYYYXSYIFYFDYWGQGTMVTVSS |
| CL-30084 | 1883 | EVQLVQSGSELKKPGASVKVSCKASGYTFNKYGMYWVRQAPGQGL<br>EWMGWINTETGKPSYAQGFTGRFVFSLDTSVSTAYLQISSLKAED<br>TAVYYCARAKYYYRSYIFYFDYWGQGTMVTVSS |
| CL-30086 | 1884 | EVQLVQSGSELKKPGASVKVSCKASGYTFLNYGMYWVRQAPGQGL<br>EWMGWINTETGRPTYAQGFTGRFVFSLDTSVSTAYLQISSLKAED<br>TAVYYCARTNYYYRIYRFYFDYWGQGTMVTVSS |
| CL-30087 | 1885 | EVQLVQSGSELKKPGASVKVSCKASGYTFYNYGMYWVRQAPGQGL<br>EWMGWINTATGKPTYAQGFTGRFVFSLDTSVSTAYLQISSLKAED<br>TAVYYCARXKYYYXSXXFYFDYWGQGTMVTVSS |
| CL-30091 | 1886 | EVQLVQSGSELKKPGASVKVSCKASGYTFSNYDMYWVRQAPGQGL<br>EWMGWINTVTGLPTYAQGFTGRFVFSLDTSVSTAYLQISSLKAED<br>TAVYYCARTIYYYKSYIFYFDYWGQGTMVTVSS |
| CL-30092 | 1887 | EVQLVQSGSELKKPGASVKVSCKASGYTFSNYGMYWVRQAPGQGL<br>EWMGWINTGTGIPTYAQGFTGRFVFSLDTSVSTAYLQISSLKAED<br>TAVYYCARTSYYYRNYLFYFDYWGQGTMVTVSS |
| CL-30093 | 1888 | EVQLVQSGSELKKPGASVKVSCKASGYTFTKYGMYWVRQAPGQGL<br>EWMGWINTETGKPTYADDFKGRFVFSLDTSVSTAYLQISSLKAED<br>TAVYYCARTTYYYRRYIFYFDYWGQGTMVTVSS |
| CL-30096 | 1889 | EVQLVQSGSELKKPGASVKVSCKASGYTFTTYAMYWVRQAPGQGL<br>EWMGWINTETGKPRYAQGFTGRFVFSLDTSVSTAYLQISSLKAED<br>TAVYYCARANYYYRSYIFYFDYWGQGTMVTVSS |
| CL-30097 | 1890 | EVQLVQSGSELKKPGASVKVSCKASGYTFSNYGMYWVRQAPGQGL<br>EWMGWINTETGKPTYADDFKGRFVFSLDTSVSTAYLQIXXLKTED<br>TAVYYCARSNYYYRGYIFYFDYWGQGTMVTVSS |
| CL-30103 | 1891 | EVQLVQSGSELKKPGASVKVSCKASGYTFAIYRMYWVRQAPGQGL<br>EWMGWINTDTGKPTYADDFKGRFVFSLDTSVSTAYLQISSLKAED<br>TAVYYCARSKYYYGFYMFYFDYWGQGTMVTVSS |
| CL-30107 | 1892 | EVQLVQSGSELKKPGASVKVSCKASGYTFMNYGMYWVRQAPGQGL<br>EWMGWINTETGRPVYAQGFTGRFVFSLDTSVSTAYLQISSLKAXD<br>TAVYYCARTNYYYLRYVFYFDYWGQGTMVTVSS |

TABLE 38-continued

List of Amino Acid Sequences of
Affinity Matured H4q8.3 VH Variants

| Clone | SEQ ID NO: | VH |
|---|---|---|
| CL-30108 | 1893 | EVQLVQSGSELKKPGASVKVSCKASGYTFTNYGMYWVRQAPGQGL<br>EWMGWINTGTGMPTYAQGFTGRFVFSLDTSVSTAYLQISSLKAED<br>TAVYYCARNKYYYRSYMFYFDYWGQGTMVTVSS |
| CL-30110 | 1894 | EVQLVQSGSELKKPGASVKVSCKASGYTFTNYDMYWVRQAPGQGL<br>EWMGWINTETGKPPYADGFTGRFVFSLDTSVSTAYLQISSLKAED<br>TAVYYCARTNYYYRSYIFYFDYWGQGTMVTVSS |
| CL-30113 | 1895 | EVQLVQSGSELKKPGASVKVSCKASGYTFTSYGMYWVRQAPGQGL<br>EWMGWINTETGIPTYADDFKGRFVFSLDTSVSTAYLQISSLKAED<br>TAVYYCARWDYYYTSYKFYFDYWGQGTMVTVSS |
| CL-30114 | 1896 | EVQLVQSGSELKKPGASVKVSCKASGYTFTIYGMYWVRQAPGQGL<br>EWMGWINTVTGNPTYADDFKGRFVFSLDTSVSTAYLQISSLKAED<br>TAVYYCARTEYYYMNYIFYFDYWGQGTMVTVSS |
| CL-30116 | 1897 | EVQLVQSGSELKKPGASVKVSCKASGYTFTNYDMYWVRQAPGQGL<br>EWMGWINTGTGKPTYADDFKGRFVFSLDTSVSTAYLQISSLKAED<br>TAVYYCARANYYYSRYDFYFDYWGQGTMVTVSS |
| CL-30119 | 1898 | EVQLVQSGSELKKPGASVKVSCKASGYTFTKYGMYWVRQAPGQGL<br>EWMGWINTQTGKPAYAQGFTGRFVFSLDTSVSTAYLQISSLKAED<br>TAVYYCARAIYYYRIYIFYFDYWGQGTMVTVSS |
| CL-30124 | 1899 | EVQLVQSGSELKKPGASVKVSCKASGYTFTNYAMYWVRQAPGQGL<br>EWMGWINTQTGEPSYAQGFTGXFVFSLDTSASTEYLXISILXDXD<br>TAVYYCARXTYYYXNYIFYFDYWGXGTMVTVSS |
| CL-30127 | 1900 | EVQLVQSGSELKKPGASVKVSCKASGYTFTTYGMYWVRQAPGQGL<br>EWMGWINTETGRPTYADDFNGWFVFSLDTSVSTAYLQISSLKAED<br>TAVYYCARTNYYYRIYIFYFDYWGQGTMVTVSS |
| CL-30128 | 1901 | EVQLVQSGSELKKPGASVKVSCKASGYTFTNYGMYWVRQAPGQGL<br>EWMGWIDTETGKPTYADDFKGRFVFSLDTSVSTAYLQISSLKAED<br>TAVYYCARTNYYYRSYIFYFDYWGQGTMVTVSS |
| CL-30129 | 1902 | EVQLVQSGSELKKPGASVKVSCKASGYTFNNYGMYWVRQAPGQGL<br>EWMGWINTGTGKPTYAQGFTGRFVFSLDTSVSTAYLQIXSLKAED<br>TAVYYCARPIYYYIRYIFYFDYWGQGTMVTVSS |
| CL-30130 | 1903 | EVQLVQSGSELKKPGASVKVSCKASGYTFADYPMYWVRQAPGQGL<br>EWMGWINTXTGQPLYAQGFTGRFVFSLDTSVSTAYLQISSLKAED<br>TAVYYCARTSYYYRSYIFYFDYWGQGTMVTVSS |
| CL-30135 | 1904 | EVQLVQSGSELKKPGASVKVSCKASGYTFTNYGMYWVRQAPGQGL<br>EWMGWINTETGKPTYADDFKGRFVFSLDTSVSTAYLQISSLKAXD<br>TAVYYCARTNYYYRSYIFYFDYWGQGTMVTVSS |
| CL-30136 | 1905 | EVQLVQSGSELKKPGASVKVSCKASGYTFTNYSMYWVRQAPGQGL<br>EWMGWINTETGKPRYAQGFTGRFVFSLDTSVSTAYLQISSLKAED<br>TAVYYCARTSYYYRSYIFYFDYWGQGTMVTVSS |
| CL-30138 | 1906 | EVQLVQSGSELKKPGASVKVSCKASGYTFTTYWMYWVRQAPGQGL<br>EWMGWINTEGEPRYAQGFTGRFVFSLDTSVSTAYLQISSLKAED<br>TAVYYCARTEYYYKSYNFYFDYWGQGTMVTVSS |
| CL-30140 | 1907 | EVQLVQSGSELKKPGASVKVSCKASGYTFTAYGMYWVRQAPGQGL<br>EWMGWINTETGMPTYADDFKGRFVFSLDTSVSTAYLQISSLKAED<br>TAVYYCARTKYYYRSYMFYFDYWGQGTMVTVSS |
| CL-30141 | 1908 | EVQLVQSGSELKKPGASVKVSCKASGYTFHNYGMYWVRQAPGQGL<br>EWMGWINTETGKPTYADDFKGRFVFSLDTSVSTAYLQISSLKAED<br>TAVYYCARTSYYYRSYFFYFDYWGQGTMVTVSS |
| CL-30142 | 1909 | EVQLVQSGSELKKPGASVKVSCKASGYTFTNYVMYWVRQAPGQGL<br>EWMGWINTETGNPTYADDFKGRFVFSLDTSVSTAYLQISSLKAED<br>TAVYYCARLIYYYXTYIFYFDYWGQGTMVTVSS |
| CL-30145 | 1910 | EVQLVQSGSELKKPGASVKVSCKASGYTFSNYAMYWVRQAPGQGL<br>EWMGWINTETGKPPYADDFKGRFVFSLDTSVSTAYLQISSLKAED<br>TAVYYCARTLYYYRTYIFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-30147 | 1911 | EVQLVQSGSELKKPGASVKVSCKASGYTFTHYGMYWVRQAPGQGL<br>EWMGWINTETGKPTYADDFKGRFVFSLDTSVSTAYLQISSLKAED<br>TAVYYCARTNYYYRRYIFYFDYWGQGTMVTVXS |
| CL-30148 | 1912 | EVQLVQSGSELKKPGASVKVSCKASGYTFSNYGMYWVRQAPGQGL<br>EWMGWINTETGQPSYADDFKGRFVFSLDTSVSTAYLQISSLKAED<br>TAVYYCARTNYYYRCYIFYFDYWGQGTMVTVSS |
| CL-30151 | 1913 | EVQLVQSGSELKKPGASVKVSCKASGYTFTNYGMYWVRQAPGQGL<br>EWMGWINTETGKPNYADDFKGRFVFSLDTSVSTAYLQISSLKAED<br>TAVYYCARPNYYYRSYIFYFDYWGQGTMVTVSS |
| CL-30154 | 1914 | EVQLVQSGSELKKPGASVKVSCKASGYTFTNYAMYWVRQAPGQGL<br>EWMGWINTETGNPTYADDFKGRFVFSLDTSVSTAYLQISSLKAED<br>TAVYYCARTNYYYGIYLFYFDYWGQGTMVTVSS |
| CL-30156 | 1915 | EVQLVQSGSELKKPGASVKVSCKASGYTFTNYDMYWVRQAPGQGL<br>EWMGWINTVTGRPAYADDFKGRFVFSLDTSVSTAYLQISSLKAED<br>TAVYYCARITYYYRMYRFYFDYWGQGTMVTVSS |
| CL-30159 | 1916 | EVQLVQSGSELKKPGASVKVSCKASGYTFIDYLMYWVRQAPGQGL<br>EWMGWINTVTGKPTYAQGFTGRFVFSLDTSVSTAYLQISSLKAED<br>TAVYYCARTHYYYRSYAFYFDYWGQGTMVTVSS |
| CL-30161 | 1917 | EVQLVQSGSELKKPGASVKVSCKASGYTFAKYEMYWVRQAPGQGL<br>EWMGWINTETGNPTYAQGFTGRFVFSLDTSVSTAYLQISSLKAED<br>TAVYYCARTNYYYRDYTFYFDYWGQGTMVTVSS |
| CL-30162 | 1918 | EVQLVQSGSELKKPGASVKVSCKASGYTFTTYRMYWVRQAPGQGL<br>EWMGWINTVTGRPSYAQGFTGRFVFSLDTSVSTAYLQISSLKAED<br>TAVYYCARNIYYYRSYIFYFDYWGQGTMVTVSS |
| CL-30164 | 1919 | EVQLVQSGSELKKPGASVKVSCKASGYTFTNYGMYWVRQAPGQGL<br>EWMGWINTETGEPTYADDFKGRFVFSLDTSVSTAYLQISSLKAED<br>TAVYYCARTNYYYRSYIFYFDYWGQGTMVTVSS |
| CL-30165 | 1920 | EVQLVQSGSELKKPGASVKVSCKASGYTFRNYVMYWVRQAPGQGL<br>EWMGWINTQTGEPSYAQGFTGRFVFSLDTSVSTAYLQISSLKAED<br>TAVYYCARTNYYYGIYIFYFDYWGQGTMVTVSS |
| CL-30166 | 1921 | EVQLVQSGSELKKPGASVKVSCKASGYTFTNYGMYWVRQAPGQGL<br>EWMGWINTETGKPTYADDFKGRFVFSLDTSVSTAYLQISSLQAED<br>TAVYYCARTNYYYRSYIFYFDYWGQGTMVTVSS |
| CL-30168 | 1922 | EVQLVQSGSELKKPGASVKVSCKASGYTFTDYGMYWVRQAPGQGL<br>EWMGWINTETGMPTYADDFKGRFVFSLDTSVSTAYLQISSLKAED<br>TAVYYCARSNYYYRGYIFYFDYWGQGTMVTVSS |
| CL-30169 | 1923 | EVQLVQSGSELKKPGASVKVSCKASGYTFLGYSMYWVRQAPGQGL<br>EWMGWINTETGKPTYADDFKGRFVFSLDTSVSTAYLQISSLKAED<br>TAVYYCARKFYYYESYIFYFDYWGQGTMVTVSS |
| CL-30170 | 1924 | EVQLVQSGSELKKPGASVKVSCKASGYTFTYYCMYWVRQAPGQGL<br>EWMGWINTHTGKPMYADDFKGRFVFSLDTSVSTAYLQISSLKAED<br>TAVYYCARKKYYYRSYIFYFDYWGQGTMVTVSS |
| CL-30593 | 1925 | EVQLVQSGSELKKPGASVKVSCKASGYTFSDYGMYWVRQAPGQGL<br>EWMGWIDTETGDPTYADDFKGRFVFSLDTSVSTAYLQISSLKAED<br>TAVYYCARTNYYMSYMFYFDYWGQGTMVTVSS |
| CL-30594 | 1926 | EVQLVQSGSELKKPGASVKVSCKASGYTFMNYGMYWVRQAPGQGL<br>EWMGWINTETGKPMYADDFKGRFVFSLDTSVSTAYLQISSLKAED<br>TAVYYCARIYYYPRYIFYFDYWGQGTMVTVSS |
| CL-30595 | 1927 | EVQLVQSGSELKKPGASVKVSCKASGYTFAMYKMYWVRQAPGQGL<br>EWMGWINTQTGGPSYAQGFTGRFVFSLDTSVSTAYLQISSLKAED<br>TAVYYCARKYYYWRYVFYFDYWGQGTMVTVSS |
| CL-30597 | 1928 | EVQLVQSGSELKKPGASVKVSCKASGYTFSNYGMYWVRQAPGQGL<br>EWMGWINTETGQPMYADDFKGRFVFSLDTSVSTAYLQISSLKAED<br>TAVYYCARTNYYYPSYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-30599 | 1929 | EVQLVQSGSELKKPGASVKVSCKASGYTFTDYGMYWVRQAPGQGL<br>EWMGWIDTETGNPTYADDFKGRFVFSLDTSVSTAYLQISSLKAED<br>TAVYYCARSNYYYSSYMFYFDYWGQGTMVTVSS |
| CL-30600 | 1930 | EVQLVQSGSELKKPGASVKVSCKASGYTFTNYGMYWVRQAPGQGL<br>EWMGWINTATGQPTYADDFKGRFVFSLDTSVSTAYLQISSLKAED<br>TAVYYCARANYYYMYYLFYFDYWGQGTMVTVSS |
| CL-30602 | 1931 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARANYYYRLYMFYFDYWGQGTMVTVSS |
| CL-30604 | 1932 | EVQLVQSGSELKKPGASVKVSCKASGYTFPNYGMYWVRQAPGQGL<br>EWMGWINTWTGKPTYAXDFTGRFVFSLDTSVSTAYLQISSLKAED<br>TAVYYCARTNYYYPSYMFYFDYWGQGTMVTVSS |
| CL-30605 | 1933 | EVQLVQSGSELKKPGASVKVSCKASGYTFTDYGMYWVRQAPGQGL<br>EWMGWINTETGEPTYADDFKGRFVFSLDTSVSTAYLQISSLKAED<br>TAVYYCARANYYYRTYMFYFDYWGQGTMVTVSS |
| CL-30606 | 1934 | EVQLVQSGSELKKPGASVKVSCKASGYTFTNYRMYWVRQAPGQGL<br>EWMGWINTETGKPTYAQGFTGRFVFSLDTSVSTAYLQISSLKAED<br>TAVYYCARTNYYYSSYMFYFDYWGQGTMVTVSS |
| CL-30608 | 1935 | EVQLVQSGSELKKPGASVKVSCKASGYTFTTYDMYWVRQAPGQGL<br>EWMGWINTVTGXPTYAXXFTGRFVFSLDTSVSTAYLQISSLKAED<br>TAVYYCARSXYYYRSYIFYFDYWGQGTMVTVSS |
| CL-30609 | 1936 | EVQLVQSGSELKKPGASVKVSCKASGYTFNNYGMYWVRQAPGQGL<br>EWMGWINTETGKPRYAQGFTGRFVFSLDTSVSTAYLQISSLKAED<br>TAVYYCARTDYYYRRYTFYFDYWGQGTMVTVSS |
| CL-30611 | 1937 | EVQLVQSGSELKKPGASVKVSCKASGYTFSNYGMYWVRQAPGQGL<br>EWMGWINTYTGIPSYADDFKGRFVFSLDTSVSTAYLQISSLKAED<br>TAVYYCARVNYYYSTYIFYFDYWGQGTMVTVSS |
| CL-30613 | 1938 | EVQLVQSGSELKKPGASVKVSCKASGYTFTNYGIYWVRQAPGQGL<br>EWMGWINTETGKPTYADDFKGRFVFSLDTSVSTAYLQISSLKAED<br>TAVYYCARSNYYYRGYMFYFDYWGQGTMVTVSS |
| CL-30614 | 1939 | EVQLVQSGSELKKPGASVKVSCKASGYTFTNYGMYWVRQAPGQGL<br>EWMGWINTETGEPTYADDFKGRFVFSLDTSVSTAYLQISSLKAED<br>TAVYYCARSNYYYRSYMFYFDYWGQGTMVTVSS |
| CL-30615 | 1940 | EVQLVQSGSELKKPGASVKVSCKASGYTFNNYGMYWVRQAPGQGL<br>EWMGWINTDTGEPTYADDFKGRFVFSLDTSVSTAYLQISSLKAED<br>TAVYYCARVNYYYRSYMFYFDYWGQGTMVTVSS |
| CL-30616 | 1941 | EVQLVQSGSELKKPGASVKVSCKASGYTFTTYGMYWVRQAPGQGL<br>EWMGWINTLTGAPMYAQGFTGRFVFSLDTSVSTAYLQISSLKAED<br>TAVYYCARTNYYYSSYIFYFDYWGQGTMVTVSS |
| CL-30617 | 1942 | EVQLVQSGSELKKPGASVKVSCKASGYTFKNYSMYWVRQAPGQGL<br>EWMGWINTDTGMPTYADDFKGRFVFSLDTSVSTAYLQISSLKAED<br>TAVYYCARTNYYYRFYIFYFDYWGQGTMVTVSS |
| CL-30618 | 1943 | EVQLVQSGSELKKPGASVKVSCKASGYTFSNYGMYWVRQAPGQGL<br>EWMGWINTETGEPTYADDFKGRFVFSLDTSVSTAYLQISSLKAED<br>TAVYYCARVNYYYRSYMFYFDYWGQGTMVTVSS |
| CL-30619 | 1944 | EVQLVQSGSELKKPGASVKVSCKASGYTFSNYGMYWVRQAPGQGL<br>EWMGWINTETGEPTYADDFTGRFVFSLDTSVSTAYLQISSLKAED<br>TAVYYCARANYYYRSYMFYFDYWGQGTMVTVSS |
| CL-30620 | 1945 | EVQLVQSGSELKKPGASVKVSCKASGYTFTDYGMYWVRQAPGQGL<br>EWMGWINTETGEPTYADDFKGRFVFSLDTSVSTAYLQISSLKAED<br>TAVYYCARTNYYYRGYMFYFDYWGQGTMVTVSS |
| CL-30623 | 1946 | EVQLVQSGSELKKPGASVKVSCKASGYTFANYGMYWVRQAPGQGL<br>EWMGWINTETGQPTYADDFKGRFVFSLDTSVSTAYLQISSLKAED<br>TAVYYCARTNYYYQSYMFYFDYWGQGTMVTVSS |

TABLE 38-continued

List of Amino Acid Sequences of
Affinity Matured H4g8.3 VH Variants

| Clone | SEQ ID NO: VH | |
|---|---|---|
| CL-30624 | 1947 | EVQLVQSGSELKKPGASVKVSCKASGYTFTNYGMYWVRQAPGQGL<br>EWMGWINTDTGTPAYADDFKGRFVFSLDTSVSTAYLQISSLKAED<br>TAVYYCARTNYYYTRYNFYFDYWGQGTMVTVSS |
| CL-30626 | 1948 | EVQLVQSGSELKKPGASVKVSCKASGYTFTDYGMYWVRQAPGQGL<br>EWMGWINTETGEPTYAQGFTGRFVFSLDTSVSTAYLQISSLKAED<br>TAVYYCARTNYYYRSYMFYFDYWGQGTMVTVSS |
| CL-30628 | 1949 | EVQLVQSGSELKKPGASVKVSCKASGYTFSNYGMYWVRQAPGQGL<br>EWMGWINTETGEPTYAQGFTGRFVFSLDTSVSTAYLQISSLKAED<br>TAVYYCARANYYYRSYMFYFDYWGQGTMVTVSS |
| CL-30629 | 1950 | EVQLVQSGSELKKPGASVKVSCKASGYTFTNYDMYWVRQAPGQGL<br>EWMGWINTETGNPTYAXXFTGRFVFSLDTSVSTAYLQISSLKAED<br>TAVYYCARXNYYYSSYIFYFDYWGQGTMVTVSS |
| CL-30630 | 1951 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARSNYYYRTYMFYFDYWGQGTMVTVSS |
| CL-30631 | 1952 | EVQLVQSGSELKKPGASVKVSCKASGYTFNNYGMYWVRQAPGQGL<br>EWMGWINTETGKPTYADDFKGRFVFSLDTSVSTAYLQISSLKAED<br>TAVYYCARTNYYYPSYMFYFDYWGQGTMVTVSS |
| CL-30632 | 1953 | EVQLVQSGSELKKPGASVKVSCKASGYTFTDYGMYWVRQAPGQGL<br>EWMGWINTETGEPTYADDFKGRFVFSLDTSVSTAYLQISSLKAED<br>TAVYYCARTNYYYPSYMFYFDYWGQGTMVTVSS |
| CL-30634 | 1954 | EVQLVQSGSELKKPGASVKVSCKASGYTFTYYGMYWVRQAPGQGL<br>EWMGWINTETGKPSYAQGFTGRFVFSLDTSVSTAYLQISSLKAED<br>TAVYYCARTIYYYTTYIFYFDYWGQGTMVTVSS |
| CL-30635 | 1955 | EVQLVQSGSELKKPGASVKVSCKASGYTFPNYGMYWVRQAPGQGL<br>EWMGWIDTETGEPIYADDFKGRFVFSLDTSVSTAYLQISSLKAED<br>TAVYYCARINYYYPNYMFYFDYWGQGTMVTVSS |
| CL-30636 | 1956 | EVQLVQSGSELKKPGASVKVSCKTSGYTFTNYGMYWVRQAPGQGL<br>EWMGWINTETGEPTYADDFKGRFVFSLDTSVSTAYLQISSLKAED<br>TAVYYCARTNYYYRGYMFYFDYWGQGTMVTVSS |
| CL-30637 | 1957 | EVQLVQSGSELKKPGASVKVSCKASGYTFTNYGMYWVRQAPGQGL<br>EWMGWINTETGEPTYAQGFTGRFVFSLDTSVSTAYLQISSLKAED<br>TAVYYCARTNYYYPSYMFYFDYWGQGTMVTVSS |
| CL-30638 | 1958 | EVQLVQSGSELKKPGASVKVSCKASGYTFSNYGMYWVRQAPGQGL<br>EWMGWIDTETGNPTYADDFKGRFVFSLDTSVSTAYLQISSLKAED<br>TAVYYCARANYYYRSYMFYFDYWGQGTMVTVSS |
| CL-30639 | 1959 | EVQLVQSGSELKKPGASVKVSCKASGYTFTDYGMYWVRQAPGQGL<br>EWMGWIDTETGTPTYADDFKGRFVFSLDTSVSTAYLQISSLKAED<br>TAVYYCARTNYYYRSYMFYFDYWGQGTMVTVSS |
| CL-30640 | 1960 | EVQLVQSGSELKKPGASVKVSCKASGYTFSSYGMYWVRQAPGQGL<br>EWMGWIDTETGEPKYADDFKGRFVFSLDTSVSTAYLQISSLKAED<br>TAVYYCARTNYYYPSYMFYFDYWGQGTMVTVSS |
| CL-30642 | 1961 | EVQLVQSGSELKKPGASVKVSCKASGYTFSNYGMYWVRQAPGQGL<br>EWMGWIDTETGEPTYADDFKGRFVFSLDTSVSTAYLQISSLKAED<br>TAVYYCARYNYYYRIYLFYFDYWGQGTMVTVSS |
| CL-30643 | 1962 | EVQLVQSGSELKKPGASVKVSCKASGYTFPYYSMYWVRQAPGQGL<br>EWMGWINTDTGTPTYAQGFTGRFVFSLDTSVSTAYLQISSLKAED<br>TAVYYCARTTYYYWSYIFYFDYWGQGTMVTVSS |
| CL-30644 | 1963 | EVQLVQSGSELKKPGASVKVSCKASGYTFTNYGMYWVRQAPGQGL<br>EWMGWINTETGDPTYADDFKGRFVFSLDTSVSTAYLQISSLKAED<br>TAVYYCARTNYYYPSYMFYFDYWGQGTMVTVSS |
| CL-30645 | 1964 | EVQLVQSGSELKKPGASVKVSCKASGYTFTNYGMYWVRQAPGQGL<br>EWMGWINTXTGKPTYADDFKGRFVFSLDTSVSTAYLQISSLKAED<br>TAVYYCARTSYYYRCYIFYFDYWGQGTMVTVSS |

TABLE 38-continued

List of Amino Acid Sequences of
Affinity Matured H4q8.3 VH Variants

| Clone | SEQ ID NO: VH | |
|---|---|---|
| CL-30647 | 1965 | EVQLVQSGSELKKPGASVKVSCKASGYTFTDYGMYWVRQAPGQGL<br>EWMGWINTETGQPTYAQGFTGRFVFSLDTSVSTAYLQISSLKAED<br>TAVYYCARTNYYYRSYMFYFDYWGQGTMVTVSS |
| CL-30649 | 1966 | EVQLVQSGSELKKPGASVKVSCKASGYTFSNYGMYWVRQAPGQGL<br>EWMGWIDTDTGKPTYAXDFKGRFVFSLDTSVSTAYLQISSLKAED<br>TAVYYCARTNYYYTGYMFYFDYWGQGTMVTVSS |
| CL-30651 | 1967 | EVQLVQSGSELEKPGASVKVSCKASGYTFPNYGMYWVRQAPGQGL<br>EWMGWIDTDTGKPTYADDFKGRFVFSLDTSVSTAYLQISSLKAED<br>TAVYYCARANYYYRSYMFYFDYWGQGTMVTVSS |
| CL-30653 | 1968 | EVQLVQSGSELKKPGASVKVSCKASGYTFNNYGMYWVRQAPGQGL<br>EWMGWIDTETGDPTYAQGFTGRFVFSLDTSVSTAYLQISSLKAED<br>TAVYYCARANYYYLSYMFYFDYWGQGTMVTVSS |
| CL-30654 | 1969 | EVQLVQSGSELKKPGASVKVSCKASGYTFSNYGMYWVRQAPGQGL<br>EWMGWINTETGEPTYADDFKGRFVFSLDTSVSTAYLQISSLKAED<br>TAVYYCARTNYYYRSYIFYFDYWGQGTMVTVSS |
| CL-30655 | 1970 | EVQLVQSGSELKKPGASVKVSCKASGYTFTNYGMYWVRQAPGQGL<br>EWMGWINTETGEPSYAQGFTGRFVFSLDTSVSTAYLQISSLKAED<br>TAVYYCARTNYYYPSYMFYFDYWGQGTMVTVSS |
| CL-30657 | 1971 | EVQLVQSGSELKKPGASVKVSCKASGYTFANYGMYWVRQAPGQGL<br>EWMGWIDTETGEPTYADDFKGRFVFSLDTSVSTAYLQISSLKAED<br>TAVYYCARTNYYYKSYMFYFDYWGQGTMVTVSS |
| CL-30658 | 1972 | EVQLVQSGSELKKPGASVKVSCKASGYTFSNYGMYWVRQAPGQGL<br>EWMGWINTDTGEPTYADDFKGRFVFSLDTSVSTAYLQISSLKAED<br>TAVYYCARTNYYYRSYMFYFDYWGQGTMVTVSS |
| CL-30659 | 1973 | EVQLVQSGSELKKPGASVKVSCKASGYTFPYYGMYWVRQAPGQGL<br>EWMGWINTETGEPTYADDFTGRFVFSLDTSVSTAYLQISSLKAED<br>TAVYYCARANYYYRMYMFYFDYWGQGTMVTVSS |
| CL-30660 | 1974 | EVQLVQSGSELKKPGASVKVSCKASGYTFTNYGMYWVRQAPGQGL<br>EWMGWIDTETGDPTYADDFKGRFVFSLDTSVSTAYLQISSLKAED<br>TAVYYCARTNYYYRGYMFYFDYWGQGTMVTVSS |
| CL-30662 | 1975 | EVQLVQSGSELKKPGASVKVSCKASGYTFTNYGMYWVRQAPGQGL<br>EWMGWINTETGSPTYADDFKGRFVFSLDTSVSTAYLQISSLKAED<br>TAVYYCARIIYYYLSYLFYFDYWGQGTMVTVSS |
| CL-30663 | 1976 | EVQLVQSGSELKKPGASVKVSCKASGYTFSNYGMYWVRQAPGQGL<br>EWMGWINTETGDPTYAQGFKGRFVFSLDTSVSTAYLQISSLKAED<br>TAVYYCARTNYYYPSYMFYFDYWGQGTMVTVSS |
| CL-30664 | 1977 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARANYYYSGYMFYFDYWGQGTMVTVSS |
| CL-30665 | 1978 | EVQLVQSGSELKKPGASVKVSCKASGYTFTDYGMYWVRQAPGQGL<br>EWMGWINTETGEPTYAQGFTGRFVFSLDTSVSTAYLQISSLKAED<br>TAVYYCARTNYYYRYYMFYFDYWGQGTMVTVSS |
| CL-30666 | 1979 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYPSYMFYFDYWGQGTMVTVSS |
| CL-30669 | 1980 | EVQLVQSGSELKKPGASVKVSCKASGYTFTKYAMYWVRQAPGQGL<br>EWMGWINTYTGVPTYADDFKGRFVFSLDTSVSTAYLQISSLKAED<br>TAVYYCARGHYYYMMYIFYFDYWGQGTMVTVSS |
| CL-30670 | 1981 | EVQLVQSGSELKKPGASVKVSCKASGYTFSNYGMYWVRQAPGQGL<br>EWMGWIDTETGKPTYADDFKGRFVFSLDTSVSTAYLQISSLKAED<br>TAVYYCARYKYYYRSYKFYFDYWGQGTMVTVSS |
| CL-30671 | 1982 | EVQLVQSGSELKKPGASVKVSCKASGYTFPDYGMYWVRQAPGQGL<br>EWMGWINTETGEPTYADDFKGRFVFSLDTSVSTAYLQISSLKAED<br>TAVYYCARTNYYYRGYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-30674 | 1983 | EVQLVQSGSELKKPGASVKVSCKASGYTFSHYGMYWVRQAPGQGL<br>EWMGWINTETGDPTYADDFKGRFVFSLDTSVSTAYLQISSLKAED<br>TAVYYCARTNYYYPSYMFYFDYWGQGTMVTVSS |
| CL-30675 | 1984 | EVQLVQSGSELKKPGASVKVSCKASGYTFPNYGMYWVRQAPGQGL<br>EWMGWINTETGEPTYAQGFTGRFVFSLDTSVSTAYLQISSLKAED<br>TAVYYCARTNYYYRSYMFYFDYWGQGTMVTVSS |
| CL-30676 | 1985 | EVQLVQSGSELKKPGASVKVSCKASGYTFTNYGMYWVRQAPGQGL<br>EWMGWIDTETGYPTYADDFKGRFVFSLDTSVSTAYLQISSLKAED<br>TAVYYCARANYYYRTYMFYFDYWGQGTMVTVSS |
| CL-30677 | 1986 | EVQLVQSGSELKKPGASVKVSCKASGYTFNNYGMYWVRQAPGQGL<br>EWMGWINTETGEPTYADDFKGRFVFSLDTSVSTAYLQISSLKAED<br>TAVYYCARTNYYYRTYMFYFDYWGQGTMVTVSS |
| CL-30678 | 1987 | EVQLVQSGSELKKPGASVKVSCKASGYTFSHYGMYWVRQAPGQGL<br>EWMGWINTETGEPTYAQGFTGRFVFSLDTSVSTAYLQISSLKAED<br>TAVYYCARANYYYRSYMFYFDYWGQGTMVTVSS |
| CL-30679 | 1988 | EVQLVQSGSELKKPGASVKVSCKASGYTFTSYRMYWVRQAPGQGL<br>EWMRWINTETGWPTYAQGFTGRFVFSLDTSVSTAYLQISSLKAED<br>TAVYYCARTSYYYRNYMFYFDYWGQGTMVTVSS |
| CL-30682 | 1989 | EVQLVQSGSELKKPGASVKVSCKASGYTFTDYGMYWVRQAPGQGL<br>EWMGWINTETGNPMYADDFKGRFVFSLDTSVSTAYLQISSLKAED<br>TAVYYCARTNYYYPSYMFYFDYWGQGTMVTVSS |
| CL-30684 | 1990 | EVQLVQSGSELKKPGASVKVSCKASGYTFTDYGMYWVRQAPGQGL<br>EWMGWINTETGEPTYADDFKGRFVFSLDTSVSTAYLQISSLKAED<br>TAVYYCARTNYYYRNYMFYFDYWGQGTMVTVSS |
| CL-30685 | 1991 | EVQLVQSGSELKKPGASVKVSCKASGYTFTNYGMYWVRQAPGQGL<br>EWMGWINTETGEPTYADDFKGRFVFSLDTSVSTAYLQISSLKAED<br>TAVYYCVRTNYYYRTYMFYFDYWGQGTMVTVSS |
| CL-32447 | 1992 | EVQLVQSGSELKKPGASVKVSCKASGYTFTDYGMYWXRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-32466 | 1993 | EVQLVQSGSELKKPGASVKVSCKASGYTFHDYGMYWVRQAPGQGL<br>EWMGWIDTETGTPTYADDFKGRFVFSLDTSVSTAYLQISSLKAED<br>TAVYYCARTNYYYSSYMFYFDYWGQGTMVTVSS |
| CL-32470 | 1994 | EVQLVQSGSELKKPGASVKVSCKASGYTFTDYGMYWVRQAPGQGL<br>EWMGWIDTETGXPTYAXXFTGRFVFSLDTSVSTAYLQISSLKAED<br>TAVYYCARTNYYYRSYMFYFDYWGQGTMVTVSS |
| CL-32507 | 1995 | EVQLVQSGSELKKPGASVKVSCKASGYTFNDYGMYWVRQAPGQGL<br>EWMGWIDTETGKPTYADDFKGRFVFSLDTSVSTAYLQISSLKAED<br>TAVYYCARTNYYYSSYMFYFDYWGQGTMVTVSS |
| CL-34445 | 1996 | EVQLVQSGSELKKPGASVKVSCKASGYTFTNYGMYWVRQAPGQGL<br>EWMGWINTETGEPTYADDFKGRFVFSLDTSVSTAYLQISSLKAED<br>TAVYYCARTNYYYRSYMFYFDYWGQGTMVTVSS |
| CL-34457 | 1997 | EVQLVQSGSELKKPGASVKVSCKASGYTFTDYGMYWVRQAPGQGL<br>EWMGWIDTETGEPTYAHDFKGRFVFSLDTSVSTAYLQISSLKAED<br>TAVYYCARXNYYYRSYMFYFDYWGQGTMVTVSS |
| CL-34458 | 1998 | EVQLVQSGSELKKPGAPVKVSCKASGYTFTDYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-34465 | 1999 | EVQLVQSGSELKKPGASVKVSCKASGYTFPDYGMYWVRQAPGQGL<br>EWMGWIDTETGQPTYADDFKGRFVFSLDTSVSTAYLQISSLKAED<br>TAVYYCARTNYYYRTYMFYFDYWGQGTMVTVSS |
| CL-34466 | 2000 | EVQLVQSGSELKKPGASVKVSCKASGYTFTDYGMYWVRQAPGQGL<br>EWMGWIDTETGEPIYAQGFKGRFVFSLDTSVSTAYLQISSLKAED<br>TAVYYCARTNYYYNSYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-34468 | 2001 | EVQLVQSGSELKKPGASVKVSCKASGYTFTDYGMYWVRQAPGQGL<br>EWMGWIDTETGEPRYAQGFTGRFVFSLDTSVSTAYLQISSLKAED<br>TAVYYCARTNYYYPSYMFYFDYWGQGTMVTVSS |
| CL-34478 | 2002 | EVQLVQSGSELKKPGASVKVSCKASGYTFPHYGMYWVRQAPGQGL<br>EWMGWIDTETGEPTYADDFKGRFVFSLDTSVSTAYLQISSLKAED<br>TAVYYCARTNYYYSSYMFYFDYWGQGTMVTVSS |
| CL-34480 | 2003 | EVQLVQSGSELKKPGASVKVSCKASGYTFEDYGMYWVRQAPGQGL<br>EWMGWINTETGEPTYAQGFTGRFVFSLDTSVSTAYLQISSLKAED<br>TAVYYCARTNYYYRNYMFYFDYWGQGTMVTVSS |
| CL-34482 | 2004 | EVQLVQSGSELKKPGASVKVSCKASGYTFTNYGMYWVRQAPGQGL<br>EWMGWIDTETGEPTYAQGFTGRFVFSLDTSVSTAYLQISSLKAED<br>TAVYYCARTNYYYRTYMFYFDYWGQGTMVTVSS |
| CL-34488 | 2005 | EVQLVQSGSELKKPGASVKVSCKASGYTFDDYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-34490 | 2006 | EVQLVQSGSELKKPGASVKVSCKASGYTFTDYGMYWVRQAPGQGL<br>EWMGWIDTETGTPTYAQGFTGRFVFSLDTSVSTAYLQISSLKAED<br>TAVYYCARTNYYYRSYMFYFDYWGQGTMVTVSS |
| CL-34493 | 2007 | EVQLVQSGSELKKPGASVKVSCKASGYTFGDYGMYWVRQAPGQGL<br>EWMGWIDTETGEPTYAQGFTGRFVFSLDTSVSTAYLQISSLKAED<br>TAVYYCARVNYYYRNYMFYFDYWGQGTMVTVSS |
| CL-34495 | 2008 | EVQLVQSGSELKKPGASVKVSCKASGYTFTDYGMYWVRQAPGQGL<br>EWMGWIDTETGQPTYADDFKGRFVFSLDTSVSTAYLQISSLKAED<br>TAVYYCARTNYYYKSYMFYFDYWGQGTMVTVSS |
| CL-34496 | 2009 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYRGYMFYFDYWGQGTMVTVSS |
| CL-34499 | 2010 | EVQLVQSGSELKKPGASVKVSCKASGYTFSDYGMYWVRQAPGQGL<br>EWMGWIDTETGDPTYADDFKGRFVFSLDTSVSTAYLQISSLKAED<br>TAVYYCARTNYYYRSYMFYFDYWGQGTMVTVSS |
| CL-34502 | 2011 | EVQLVQSGSELKKPGASVKVSCKASGYTFSNYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-34503 | 2012 | EVQLVQSGSELKKPGASVKVSCKASGYTFSDYGMYWVRQAPGQGL<br>EWMGWIDTETGTPTYAQGFTGRFVFSLDTSVSTAYLQISSLKAED<br>TAVYYCARTNYYYKSYMFYFDYWGQGTMVTVSS |
| CL-34505 | 2013 | EVQLVQSGSELKKPGASVKVSCKASGYTFTDYGMYWVRQAPGQGL<br>EWMGWIDTETGQPTYADDFKGRFVFSLDTSVSTAYLQISSLKAED<br>TAVYYCARTNYYYPSYMFYFDYWGQGTMVTVSS |
| CL-34510 | 2014 | EVQLVQSGSELKKPGASVKVSCKASGYTFSHYGMYWVRQAPGQGL<br>EWMGWIDTETGEPTYADDFKGRFVFSLDTSVSTAYLQISSLKAED<br>TAVYYCARTNYYYMSYMFYFDYWGQGTMVTVSS |
| CL-34512 | 2015 | EVQLVQSGSELKKPGASVKVSCKASGYTFTDYGMYWVRQAPGQGL<br>EWMGWIDTDTGTPTYADDFKGRFVFSLDTSVSTAYLQISSLKAED<br>TAVYYCARTNYYYPKYMFYFDYWGQGTMVTVSS |
| CL-34527 | 2016 | EVQLVQSGSELKKPGASVKVSCKASGYTFANYGMYWVRQAPGQGL<br>EWMGWIDTETGTPTYADDFKGRFVFSLDTSVSTAYLQISSLKAED<br>TAVYYCARTNYYYRSYMFYFDYWGQGTMVTVSS |
| CL-34528 | 2017 | EVHLVQSGSELKKPGASVKVSCKASGYTFSNYGMYWVRQAPGQGL<br>EWMGWIDTETGKPTYADDFKGRFVFSLDTSVSTAYLQISSLKAED<br>TAVYYCARTNYYYRSYMFYFDYWGQGTMVTVSS |
| CL-34529 | 2018 | EVQLVQSGSELNKPGASVKVSCKASGYTFTNYGMYWVRQAPGQGL<br>EWMGWIDTETGEPSYADDFKGRFVFSLDTXVSTAYXQISSLKAED<br>XAVYXCARTNYYYSSYMFYFDYWGQGTXVTVSS |

TABLE 38-continued

List of Amino Acid Sequences of
Affinity Matured H4g8.3 VH Variants

| Clone | SEQ ID NO: | VH |
|---|---|---|
| CL-34534 | 2019 | EVQLVQSGSELKKPGASVKVSCKASGYTFNDYGMYWVRQAPGQGL<br>EWMGWIDTETGNPTYADDFKGRFVFSLDTSVSTAYLQISSLKAED<br>TAVYYCARANYYYRSYMFYFDYWGQGTMVTVSS |
| CL-34539 | 2020 | EVQLVPSGSHFNNPGASXKVSCSASGYTFSDYGMYWVRQAPGQGL<br>EWMGWIDTETGDPTYADDFKGXFVFSLDTSVXXAYLQISSLKAED<br>TAVYYCARTNYYYRSYMFYFDYWGQGTMVTVSS |
| CL-34548 | 2021 | EVQLVQSGSELKKPGASVKVSCKASGYTFTDYGMYWVRQAPGQGL<br>EWMGWIDTETGDPTYADDFKGRFVFSLDTSVSTAYLQISSLKAED<br>TAVYYCARTNYYYPSYMFYFDYWGQGTMVTVSS |
| CL-34562 | 2022 | EVQLVQSGSELKKPGASVKVSCKASGYTFTDYGMYWVRQAPGQGL<br>EWMGWIDTETGKPTYADDFTGRFVFSLDTSVSTAYLQISSLKAED<br>TAVYYCARTNYYYRTYMFYFDYWGQGTMVTVSS |
| CL-34568 | 2023 | EVQLVQSGSELKKPGASVKVSCKASGYTFTDYGMYWVRQAPGQGL<br>EWMGWIDTETGQPTYAQGFTGRFVFSLDTSVSTAYLQISSLKAED<br>TAVYYCARTNYYYRSYMFYFDYWGQGTMVTVSS |
| CL-34577 | 2024 | EVQLVQSGSELKKPGASVKVSCKASGYTFTNYGMYWVRQAPGQGL<br>EWMGWIDTETGTPTYADDFKGRFVFSLDTSVSTAYLQISSLKAED<br>TAVYYCARTNYYYESYMFYFDYWGQGTMVTVSS |
| CL-34582 | 2025 | EVQLVQSGSELKKPGASVKVSCKASGYTFSNYGMYWVRQAPGQGL<br>EWMGWIDTETGEPTYADDFKGRFVFSLDTSVSTAYLQISSLKAED<br>TAVYYCARTNYYYPSYMFYFDYWGQGTMVTVSS |
| CL-34586 | 2026 | EVQLVQSGSELKKPGASVKVSCKASGYTFTDYGMYWVRQAPGQGL<br>EWMGWIDTETGEPTYAXXFTGRFVFSLDTSVSTAYLQISSLKAED<br>TAVYYCARTNYYYRSYMFYFDYWGQGTMVTVSS |
| CL-34590 | 2027 | EVQLVQSGSELKKPGASVKVSCKASGYTFTDYGMYWVRQAPGQGL<br>EWMGWIDTETGKPTYADDFKGRFVFSLDTSVSTAYLQISSLKAED<br>TAVYYCARTNYYYRSYMFYFDYWGQGTMVTVSS |
| CL-34592 | 2028 | EVQLVQSGSELKKPGASVKVSCKASGYTFNDYGMYWVRQAPGQGL<br>EWMGWIDTETGTPTYADDFKGRFVFSLDTSVSTAYLQISSLKAED<br>TAVYYCARTNYYYSSYMFYFDYWGQGTMVTVSS |
| CL-34595 | 2029 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYRTYMFYFDYWGQGTMVTVSS |
| CL-34596 | 2030 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYRNYMFYFDYWGQGTMVTVSS |
| CL-34597 | 2031 | EVQLVQSGSELKKPGASVKVSCKASGYTFTNYGMYWVRQAPGQGL<br>EWMGWIDTETGEPTYAQGFTGRFVFSLDTSVSTAYLQISSLKAED<br>TAVYYCARTNYYYRSYMFYFDYWGQGTMVTVSS |
| CL-34599 | 2032 | EVQLVQSGSELKKPGASVKVSCKASGYTFSDYGMYWVRQAPGQGL<br>EWMGWIDTETGEPTYAQGFTGRFVFSLDTSVSTAYLQISSLKAED<br>TAVYYCARTNYYYPSYMFYFDYWGQGTMVTVSS |
| CL-34600 | 2033 | EVQLVQSGSELKKPGASVKVSCKASGYTFTDYGMYWVRQAPGQGL<br>EWMGWIDTETGEPTYADDFKGRFVFSLDTSVSTAYLQISNLKAED<br>TAVYYCARTNYYYRSYMFYFDYWGQGTMVTVSS |
| CL-34617 | 2034 | EVQLVQSGSELKKPGASVKVSCKASGYTFTDYGMYWVRQAPGQGL<br>EWMGWIDTETGEPTYADDFKGRFVFSLDTSVSTAYLQISSLKAED<br>TAVYYCARTNYYYPRYMFYFDYWGQGTMVTVSS |
| CL-40631 | 2035 | EVQLVQSGSELKKPGASVKVSCXASGYTFSDYGMYWVRQAPGQGL<br>EWMGWIDTETGDPTYADDFKGRFVFSLDTSVSTAYLQISSLKAED<br>TAVYYCARANYYYRSYMFYFDYWGQGTMVTVSS |
| CL-40642 | 2036 | RVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |

TABLE 38-continued

List of Amino Acid Sequences of
Affinity Matured H4g8.3 VH Variants

| Clone | SEQ ID NO: | VH |
|---|---|---|
| CL-40646 | 2037 | EVQLVQSGSELKKPGASVKVSCEASGYTFSDYGMYWVRQAPGQGL<br>EWMGWIDTETGDPTYADDFKGRFVFSLDTSVSTAYLQISSLKAED<br>TAVYYCARANYYYRSYMFYFDYWGQGTMVTVSS |
| CL-40665 | 2038 | EVQLVQSGSELKKPGASVKVSCKASGYTFTNYGMYWVRQAPGQGL<br>EWMGWIDTETGEPTYAQGFTGRFVFSLDTSVSTAYLQISSLKAED<br>TAVYYCARTNYYYPSYMFYFDYWGQGTMVTSLQ |
| CL-40668 | 2039 | EVQLVQSGSELKKPGASVKVSCKASGYTFTNYGMYWVRQAPGQGL<br>EWMGWIDTETGEPTYADDFKGRFVFSLDTSVSTAYLQISSLKVED<br>TAVYYCARTNYYYRSYMFYFDYWGQGTMVTVSS |
| CL-40671 | 2040 | EVQLVQSGSELKKPGASVKVSCKASGYTFTNYGMYWVRQAPGQGL<br>EWMGWIDTETGTPTYADDFKGRFVFSLDTSVSTAYLQISSLKAED<br>TAVYYCARTNYYYSSYMFYFDYWGQGTMVTVSS |
| CL-40687 | 2041 | ASAAVQSGSELKKPGASVKVSCKASGYTFENYGMYWVRQAPGQGL<br>EWMGWIDTETGEPTYADDFKGRFVFSLDTSVSTAYLQISSLKAED<br>TAVYYCARTNYYYSSYMFYFDYWGQGTMVTVSS |
| CL-40688 | 2042 | EVQLVQSGSELKKPGASVKVSCKASGYTFENYGMYWVRQAPGQGL<br>EWMGWIDTETGEPTYADDFKGRFVFSLDTSVSTAYLQISSLKAED<br>TAVYYCARTNYYYSSYMFYFDYWGQGTMVTVSS |
| CL-40694 | 2043 | EVQLVQSGSELKKPGASVKVSCKASGYTFENYGMYWVRQAPGQGL<br>EWMGWIDTETGEPTYADDFKGRFVFSLGTSVSTAYLQISSLKAED<br>TAVYYCARTNYYYSSYMFYFDYWGQGTMVTVSS |
| CL-40708 | 2044 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYSSYMFYFDYWGQGTMVTVSS |
| CL-40716 | 2045 | EVQLVQSGSELKKPGASVKVSCKASGYTFSDYGMYWVRQAPGQGL<br>EWMGWIDTETGDPTYADDFKGRFVFSLDTSVSTAYLQISSLKAED<br>TAVYYCARANYYYRSYMFYFDYWGQGTMVTVSS |
| CL-40717 | 2046 | EVQLVQSGSELKKPGASVKVSCKASGYTFDDYGMYWVRQAPGQGL<br>EWMGWIDTETGTPTYADDFKGRFVFSLDTSVSTAYLQISSLKAED<br>TAVYYCARTNYYYSSYMFYFDYWGQGTMVTVSS |
| CL-40721 | 2047 | EVQLVQSGSELKKPGASVKVSCKASGYTFTNYGMYWVRQAPGQGL<br>EWMGWIDTETGEPTYAQGFTGRFVFSLDTSVSTAYLQISSLKAED<br>TAVYYCARTNYYYPSYMFYFDYWGQGTMVTVSS |
| CL-40722 | 2048 | EVQLVQSGSELKKPGASVKVSCKASGYTFTNYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-40723 | 2049 | EVQLVQSGSELKKPGASVKVSCKASGYTFTDYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-40736 | 2050 | EVQLVQSGSELKKPGASVKVSCKASGYTFTHYGMYXVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-40740 | 2051 | EVQLVQSGSELKKPGASVKVSCKASGYTFSDYGMYWVRQAPGQGL<br>EWMGWIDTETGDPTYADDFKGRFVFSLDTSVSTAYLQISSLKAED<br>TAVYYCARTNYYYPSYMFYFDYWGQGTMVTVSS |
| CL-40741 | 2052 | EVQLVQSGSELKKPGASVKVSCKASGYTFTDYGMYWVRQAPGQGP<br>EWMGWIDTETGNPTYADDFKGRFVFSLDTSVSTAYLQISSLKAED<br>TAVYYCARTNYYYPSYMFYFDYWGQGTMVTVSS |
| CL-40742 | 2053 | EVQLVQSGSELKKPGASVKVSCKASGYTFTHYGMYWVRQAPGQGL<br>EWMGWIDTETGEPTYADDFKGRFVFSLDTSVSTAYLQISSLKAEN<br>TAVYYCARTNYYYRSYMFYFDYWGQGTMVTVSS |
| CL-40745 | 2054 | EVQLVQSGSELKKPGASVKVSCKASGYTFTDYGMYWVRQAPGQGL<br>EWMGWIDTETGEPTYAQGFTGRFVFSLDTSVSTAYLQISSLKAED<br>TAVYYCARTNYYYRSYMFYFDYWGQGTMVTVSS |

TABLE 38-continued

List of Amino Acid Sequences of
Affinity Matured H4q8.3 VH Variants

| Clone | SEQ ID NO: | VH |
|---|---|---|
| CL-40746 | 2055 | EVQLVQSGSXLKXPGXSXKVSCXVSGYTFQNYGMYCVRPAPGQWL<br>XWMGWIDXXTGEPTYAYDFKGWFLFSLHTSVSMSSLQNXSLKXDD<br>TAVYYCAKTNYYYNSYMFYFDYWGQGTXXTVSS |
| CL-40747 | 2056 | EVQLVQSGSELKKPGASVKVSCKASGYTFTDYGMYWVRQAPGQGL<br>EWMGWIDTETGQPTYADDFKGRFVFSLDTSVSTAYLQISSLKAED<br>TAVYYCARTNYYYRNYMFYFDYWGQGTMVTVSS |
| CL-40753 | 2057 | EVQLVQSGSELKKPGASVKVSCKASGYTFTDYGMYWVRQAPGQGL<br>EWMGWIDTETGDPTYADDFKGRFVFSLDTSVSTAYLQISSLKAED<br>TAVYYCARTNYYYRNYMFYFDYWGQGTMVTVSS |
| CL-40758 | 2058 | EVQLVQSGSELKKPGASVKVSCKASGYTFTDYGMYWVRQAPGQGL<br>EWMGWIDTETGEPTYAQGFTGRFVFSLDTSVSTAYLQISSLKAED<br>TAVHYCARTNYYYRSYMFYFDYWGQGTMVTVSS |
| CL-40760 | 2059 | EVQLVQSGSELKKPGASVKVSCKASGYTFSNYGMYWVRQAPGQGL<br>EWMGWIDTETGEPTYADDFKGRFVFSLDTSVSTAYLQISSLKAED<br>TAVYYCARTNYYYSSYMFYFDYWGQGTMVTVSS |
| CL-40763 | 2060 | EVQLVQSGSELKKPGASVKVSCKASGYTFTHYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-40764 | 2061 | EVQLVQSGSELKKPGASVKVSCKASGYTFTDYGMYWVRQAPGQGL<br>EWMGWIDTETGNPTYADDFKGRFVFSLDTSVSTAYLQISSLKAED<br>TAVYYCARTNYYYPSYMFYFDYWGQGTMVTVSS |
| CL-40765 | 2062 | EVQLVQSGSELKKPGASVKVSCKASGYTFTDYGMYWVRQAPGQGL<br>EWMGWIDTETGQPTYADDFKGRFVFSLDTSVSTAYLQISSLKAED<br>TAVYYCARTNYYYRSYMFYFDYWGQGTMVTVSS |
| CL-40766 | 2063 | EVQLVQSGSELKKPGASVKVSCKASGYTFSNYGMYWVRQAPGQGL<br>EWMGWIDTETGEPTYADDFKGRFVFSLDTSVSTAYLQISSLKAEG<br>TAVYYCARTNYYYSSYMFCFDYWGQGTMVTVSS |
| CL-40768 | 2064 | EVQLVQSGSELKKPGASVKVSCKASGYTFSNYGMYWVRQAPGQGL<br>EWMGWIDTETGEPTYADDFKGRFVFSLDTSVSTAYLQISSLKAED<br>TAVYYCARTNYYYSSYMFYFDYWGQGAMVTVSS |
| CL-40770 | 2065 | EVQLVQSGSELKKPGASVKVSCKASGYTFTHYGMYWVRRAPGQGL<br>EWMGWIDTETGEPTYADDFKGRFVFSLDTSVSTAYLQISSLKAED<br>TAVYYCARTNYYYRSYMFYFDYWGQGTMVTVSS |
| CL-40774 | 2066 | EVQLVQSGSELKKPGASVKVSCKASGYTFSDYGMYWVRQAPGQGL<br>EWMGWIDTETGEPTYADDFKGRFVFSLDTSVSTAYLQISSLKVED<br>TAVYYCARTNYYYRSYMFYFDYWGQGTMVTVSS |
| CL-40779 | 2067 | EVQLVQSGSELKKPGASVKVSCKASGYTFTDYGMYWVRQAPGQGL<br>EWMGWIDTETGEPTYADDFKGRFVFSLDTSVSTAYLQISSLKAED<br>TAVYYCARTNYYYPSYMFYFDYWGQGTMVTVSS |
| CL-40780 | 2068 | EVQLVQSGSELEKPGASVKVSCKASGYTFTDYGMYWVRQAPGQGL<br>EWMGWIDTETGEPTYADDFKGRFVFSLDTSVSTAYLQISSLKAED<br>TAVYYCARTNYYYRGYMFYFDYWGQGTMVTSLQ |
| CL-40788 | 2069 | EVQLVQSGSELKKPGASVKVSCKASGYTFTDYGMYWVRQAPGQGL<br>EWMGWIDAETGEPTYADDFKGRFVFSLDTSVSTAYLQISSLKAED<br>TAVYYCARTNYYYRGYMFYFDYWGQGTMVTVSS |
| CL-40790 | 2070 | EGHLGQSGSELKNPGASVKVSCXASGYTFXNYGMYWVRQAPGQGL<br>EWMGWIDTETGEPTYAXDFKGRFVFSLGTSVSTAYLQIXSLRAED<br>TAVYYCEXTNYYYSRYMFYFXYWGQGTMVTVSS |
| CL-40791 | 2071 | EVQLVQSGSELKKPGASVKVSCKASGYTFTNYGMYWVRQAPGQGL<br>EWMGXIDTETGEPTYADDFKGRFVFSLDTSVSTAYLQISSLKAED<br>TAVYYCARTNYYYKSYMFYFDYWGQGTMVTVSS |
| CL-40793 | 2072 | EVQLVQSGSELKKPGASVKVSCKASGYTFSDYGMYWVRQAPGQGL<br>EWMGWIDTETGEPTYADDFKGRFVFSLDTSVSTAYLQISSLKAED<br>TAVYYCARTNYYYRSYMFYFDYWGQGTMVTVFS |

TABLE 38-continued

List of Amino Acid Sequences of
Affinity Matured H4g8.3 VH Variants

| Clone | SEQ ID NO: | VH |
|---|---|---|
| CL-40795 | 2073 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARTNYYYRGYMLYFDYWGQGTMVTVSS |
| CL-40796 | 2074 | EVQLVQSGSELKKPGASVKVSCKASGYTFPNYGMYWVRQAPGQGL EWMGWIDTETGEPTYADDFKGRFVFSLDTSVSTAYLQISSLKAED TAVYYCARTNYYYKSYMFYFDYWGQGTMVTVSS |
| CL-40800 | 2075 | EVQLVQSGSELKKPGASVKVSCKASGYTFTDYGMYWVRRAPGQGL EWMGWIDTETGEPTYADDFKGRFVFSLDTSVSTAYLQISSLKAED TAVYYCARTNYYYRGYMFYFDYWGQGTMVTVSS |
| CL-40801 | 2076 | EVQLVQSGSELKKPGASVKVSCKASGYTFTNYGMYWVRQAPGQGL EWMGWIDTETGEPTYADDFKGRLVFSLDTSVSTAYLQISSLKAED TAVYYCARTNYYYKSYMFYFDYWGQGTMVTVSS |
| CL-40805 | 2077 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARTNYYYSSYMFYFDYWGQGTMVTVSS |
| CL-40806 | 2078 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARTNYYYRGYMFYFDYWGQGTMVTVSS |
| CL-40811 | 2079 | EVQLVQSGSELKKPGASVKVSCKASGYTFPNYGMYWVRQAPGQGL EWMGWIDTETGEPTYADDFKGRFVFSLDTSVSTAYLQISSLKAED TAVYYCARTNYYYRSYMFYFDYWGQGTMVTVSS |
| CL-40812 | 2080 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARTNYYYXSYMFYFDYWGQGTMVTVSS |
| CL-40815 | 2081 | EVQLVQSGSELKKPGASVKVSCKASGYTFTNYGMYWVRQAPGQGL EWMGWIDTETGEPTYADDFKGRFVFSLDTSVSTAYLQISSLKAED TAVYYCARTNYYYKSYMFYFDYWGQGTMVTVSS |
| CL-40816 | 2082 | EVQLVQSGSELKKPGASVKVSCKASGYTFTDYGMYWVRQAPGQGL EWMGWIDTETGEPTYADDFKGQFVFSLDTSVSTAYLQISSLKAED TAVYYCARTNYYYPSYMFYFDYWGQGTMVTVSS |
| CL-40817 | 2083 | EVQLVQSGSELKKPGASVKVSCKASGYTFTDYGMYWVRQAPGQGL EWMGWIDTETGEPTYADDFKGRFVFSLDTSVSTAYLQISSLKAED TAVYYCARTNYYYPSHMFYFDYWGQGTMVTVSS |
| CL-40819 | 2084 | EVQLVQSGSELKKPGASVKVSCKASGYTFSDYGMYWVRQAPGQGL EWMGWIDTETGEPTYADDFKGRFVFSLDTSVSTAYLQISSLKAED TAVYYCARTNYYYRSYMFYFDYWGQGTMVTVSS |

List of Amino Acid Sequences of Affinity Matured h4G8.3 VL Variants

Table 39 provides a list of amino acid sequences of unique, functional VL regions of affinity matured humanized VEGF antibodies derived from hBDB-4G8.3. Amino acid residues of individual CDRs of each VL sequence are indicated in bold.

TABLE 39

List of Amino Acid Sequences of Affinity Matured
H4q8.3 VL Variants

| Clone | SEQ ID NO: | VL |
|---|---|---|
| CL-27686 | 2085 | EIVLTQSPATLSLSPGERATLSCRASESVSTHMHWYQQKPGXA PRLLIYGASNLESGVPARFSGSGSGTDFTLTISSLEPEDFAVY FCQQSWNDPFTFGQGTKLEIK |
| CL-27698 | 2086 | EIVLTQSPATLSLSPGERATLSCRASESVSTHMHWYQQKPGQA PRLLIYGASNLESGVPARFSGSRSGTDFTLTISSLEPEDFAVY FCQQSWNDPFTFGQGTKLEIK |
| CL-27717 | 2087 | EIVLTQSPATLSLSPGERATLSCRASESVSTHMHWYQQKPGQA PRLLIYGASNLESGVPARFSGSGSGTDFTLTISSLEPEDFAVY FCQQSWNDPFTFGQGAKLEIK |

TABLE 39-continued

List of Amino Acid Sequences of Affinity Matured H4q8.3 VL Variants

| Clone | SEQ ID NO: | VL |
|---|---|---|
| CL-27741 | 2088 | EIVLTQSPATLSLSPGERATLSCRASESVSTHMHWYQQKPGQAPRLLIYGASNLESGVPARFSGSGSGTDFTLTISSLEPEDFAVYFCQQSWNDPFTFGLGTKLEIK |
| CL-27758 | 2089 | EIVLTQFPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| CL-27762 | 2090 | EIVLTQSPATLSLSPGERATLSCRASQSVTPHMHWYQQKPGQAPRLLIYGASTLESGIPARFSGSGSGTDFTLTISSLEPEDFAVYYCQQSCNDPFTFGQGTKLEIK |
| CL-27763 | 2091 | EIVLTQSPATLSLSPGERATLSCRASESVDKYMHWYQQKPGQAPRLLIYGASNLESGVPARFSGSGSGTDFTLTISSLEPEDFAVYFCQQSRNDPLTFGQGTKLEIK |
| CL-27764 | 2092 | EIVLTQSPATLSLSPGERATLSCRASQSVKTDMHWYQQKPGQAPRLLIYGASNLESGVPARFSGSGSGTDFTLTISSLEPEDFAVYYCQQSRNEPFTFGQGTKLEIK |
| CL-27765 | 2093 | EIVLTQSPATLSLSPGERATLSCRASQSVSTHLAWYQQKPGQAPRLLIYRASKLESGVPARFSGSGSGTDFTLTISSLEPEDFAVYYCQQNWNDPLTFGQGTKLEIK |
| CL-27766 | 2094 | EIVLTQSPATLSLSPGERATLSCRASQSVRTHMHWYQQKPGQAPRLLIYGASALESGIPARFSGSGSGTDFTLTISSLEPEDFAVYYCQQGCNXPFTFGQGTKLEIK |
| CL-27767 | 2095 | EIVLTQSPATLSLSPGERATLSCRASQSVRTHMHWYQQKPGQAPRLLIYEASNLESGIPARFSGSGSGTDFTLTISSLEPEDFAVYFCQQSCNDPFTFGQGTKLEIK |
| CL-27768 | 2096 | EIVLTQSPATLSLSPGERATLSCRASQSVSTDMHWYQQKPGQAPRLLIYGASKLESGIPARFSGSGSGTDFTLTISSLEPEDFAVYFCQQSWNDPFTFGQGTKLEIK |
| CL-27770 | 2097 | EIVLTQSPATLSLSPGERATLSCRASQSVSPHMHWYQQKPGQAPRLLIYGASKLESGVPARFSGSGSGTDFTLTISSLEPEDFAVYYCQQTSNEPFTFGQGTKLEIK |
| CL-27771 | 2098 | EIVLTQSPATLSLSPGERATLSCRASQSVSTHMHWYQQKPGQAPRLLIYGASDLESGIPARFSGSGSGTDFTLTISSLEPEDFAVYFCQQSXIDPVTFGQGTKLEIK |
| CL-27772 | 2099 | EIVLTQSPATPSLSPGERATLSCRASESVNAHMHWYQQKPGQAPRLLIYDASKLESGVPARFSGSGSGTDFTLTISSLEPEDFAVYYCQQSWSDPFTFGQGTKLEIK |
| CL-27773 | 2100 | EIVLTQSPATLSLSPGERATLSCRASESVRTQLAWYQQKPGQAPRLLIYSASNLESGIPARFSGSGSGTDFTLTISSLEPEDFAVYYCQQSRTEPFTFGQGTKLEIK |
| CL-27774 | 2101 | EIVLTQSPATLSLSPGERATLSCRASQSVSTPMHWYQQKPGQAPRLLIYSASNLESGIPARFSDSGSGTDFTLTISSLEPEDFAVYYCQQFWDDPYTFGQGTKLEIK |
| CL-27775 | 2102 | EIVLTQSPATLSLSPGERATLSCRASESVITHLAWYQQKPGQAPRLLIYSASILESGIPARFSGSGSGTDFTLTISSLEPEDFAVYYCQQCCIDPFTFGQGTKLEIK |
| CL-27776 | 2103 | EIVLTQSPATLSLSPGERATLSCRASQSVRSQLAWYQQKPGQAPRLLIYVASNLESGVPARFSGSGSGTDFTLTISSLEPEDFAVYYCQQSXNDPFTFGQGTKLEIK |
| CL-27779 | 2104 | EIVLTQSPATLSLSPGERATLSCRASESVRTHMHWYQQKPGQAPRLLIYGASKLESGVPARFSGSGSGTDFTLTISSLEPEDFAVYYCQQSWIDPFTFGQGTKLEIK |
| CL-27780 | 2105 | EIVLTQSPATLSLSPGERATLSCRASESVSIHLAWYQQKPGQAPRLLIYGASNLESGVPARFSGSGSGTDFTLTISSLEPEDFAVYYCQQSWNDPFTFGQGTKLEIK |

TABLE 39-continued

List of Amino Acid Sequences of Affinity Matured H4q8.3 VL Variants

| Clone | SEQ ID NO: | VL |
|---|---|---|
| CL-27781 | 2106 | EIVLTQSPATLSLSPGERATLSCRASQSVSTPMHWYQQKPGQA PRLLIYGASYLESGVPARFSGSGSGTDFTLTISSLEPEDFAVY YCQQSWNEPYTFGQGTKLEIK |
| CL-27782 | 2107 | EIVLTQSPATLSLSPGERATLSCRASESVSAHMHWYQQKPGQA PRLLIYGASNLESGVPARFSGSGSGTDFTLTISSLEPEDFAVY YCQQSWIYPFTFGQGTKLEIK |
| CL-27783 | 2108 | EIVLTQSPATLSLSPGERATLSCRASQSVRTHMHWYQQKPGQA PRLLIYGASHLESGIPARFSGSGSGIDFTLTISSLEPEDFAVY YCQQSXRYPFTFGQGTKLEIK |
| CL-27784 | 2109 | EIVLTQSPATLSLSPGERATLSCRASQSVRTHMHWYQQKPGQA PRLLIYRASNLESGIPARFSGSGSGTDFTLTISSLEPEDFAVY YCQQRSNEPFTFGQGTKLEIK |
| CL-27785 | 2110 | EIVLTQSPATLSLSPGERATLSCRASQSVRSHMHWYQQKPGQA PRLLIYGASGLESGIPARFSGSGSGTDFTLTISSLEPEDFAVY FCQQRWNEPSTFGQGTKLEIK |
| CL-27786 | 2111 | EIVLTQSPATLSLSPGERATLSCRASQSVRFHMHWYQQKPGQA PRLLIYGASPLESGIPARFSGSGSGTDFTLTISSLEPEDFAVY YCQQSRRHPFTFGQGTKLEIK |
| CL-27787 | 2112 | EIVLTQSPATLSLSPGERATLSCRASQSVSIQMHWYQQKPGQA PRLLIYGASKLESGIPARFSGSGSGTDFTLTISSLEPEDFAVY YCQQQWNVPFTFGQGTKLEIK |
| CL-27788 | 2113 | EIVLTQSPATLSLSPGERATLSCRASQSVSTPMHWYQQKPGQA PRLLIYRASNLESGIPARFSGSGSGTDFTLTISSLEPEDFAVY YCQQGGNDPYTFGQGTKLEIK |
| CL-27790 | 2114 | EIVLTQSPATLSLSPGERATLSCRASESVSTHMHWYQQKPGQA PRLLIYWASDLESGVPARFSGSGSGTDFTLTISSLEPEDFAVY YCQQCWNGPLTFGQGTKLEIK |
| CL-27791 | 2115 | EIVLTQSPATLSLSPGERATFSCRASESVSTHMHWYQQKPGQA PRLLIYGASNLESGVPARFSGSGCGTDFTLTISSLEPEDFAVY XCQQSGNDPFTFGQGTKLEIK |
| CL-27792 | 2116 | EIVLTQSPATLSLSPGERATLSCRASQSVSTHMHWYQQKPGQA PRLLIYRASNLESGIPARFSGSGSGTDFTLTISSLEPEDFAVY YCQQGGNVPCTFGQGTKLEIK |
| CL-27794 | 2117 | EIVLTQSPATLSLSPGERATLSCRASESVSWHMHWYQQKPGQA PRLLIYGASNLESGIPARFSGSGSGTDFTLTISSLEPEDFAVY YCQQIRADPFTFGQGTKLEIK |
| CL-27795 | 2118 | EIVLTQSPATLSLSPGERATLSCRASESVCAHMHWYQQKPGQA PRLLIYWASKLESGVPARFSGSGSGTDFTLTISSLEPEDFAVY YCQQSGLDPVTFGQGTKLEIK |
| CL-27796 | 2119 | EIVLTQSPATLSLSPGERATLSCRASESVSTQMHWYQQKPGQA PRLLIYGASILESGIPARFSGSGSGTDFTLTISSLEPEDFAVY FCQQSGNNPFTFGQGTKLEIK |
| CL-27797 | 2120 | EIVLTQSPATLSLSPGERATLSCRASQSVSTLMHWYQQKPGQA PRLLIYRASILESGVPARFSGSGSGTDFTLTISSLEPEDFAVY YCQQGWNKPFTFGQGTKLEIK |
| CL-27798 | 2121 | EIVLTQSPATLSLSPGERATLSCRASQSVTTHLAWYQQKPGQA PRLLIYWASNLESGVPARFSGSGSGTDFTLTISSLEPEDFAVY YCQQSSKNPFTFGQGTKLEIK |
| CL-27799 | 2122 | EIVLTQSPATLSLSPGERATLSCRASESVSXHMHWYQQKPGQA PRLLIYWASNLESGIPARFSGSGSGTDFTLTISSLEPEDFAVY FCQQSWNDPPTFGQGTKLEIK |
| CL-27800 | 2123 | EIVLTQSPATLSLSPGERATLSCRASQSVSSHLAWYQQKPGQA PRLLIYGASKLESGIPARFSGSGSGTDFTLTISSLEPEDFAVY YCQQSSRDPFTFGQGTKLEIK |

TABLE 39-continued

List of Amino Acid Sequences of Affinity Matured H4q8.3 VL Variants

| Clone | SEQ ID NO: | VL |
|---|---|---|
| CL-27801 | 2124 | EIVLTQSPATLSLSPGERATLSCRASQSVTTNMHWYQQKPGQAPRLLIYGASNLESGIPARFSGSGSGTDFTLTISSLEPEDFAVYFCQQRWNDPFTFGQGTKLEIK |
| CL-27802 | 2125 | EIVLTQSPATLSLSPGERATLSCRASQSVSTHLAWYQQKPGQAPRLLIYGASNLESGIPARFSGSGSGTDFTLTISSLEPEDFAVYYCQQKSNXPFTFGQGTKLEIK |
| CL-27803 | 2126 | EIVLTQSPATLSLSPGERATLSCRASQSVSTHMHWYQQKPGQAPRLLIYRASNLESGVPARFSGSGSGTDFTLTISSLEPEDFAVYFCQQSWKDPYTFGQGTKLEIK |
| CL-27805 | 2127 | EIVLTQSPATLSLSPGERATLSCRASQSVSAHLAWYQQKPGQAPRLLIYEASNLESGVPARFSGSGSGTDFTLTISSLEPEDFAVYYCQQSWNVPFTFGQGTKLEIK |
| CL-27806 | 2128 | EIVLTQSPATLSLSPGERATLSCRASESVLILMHWYQQKPGQAPRLLIYEASNLESGVPARFSGSGSGTDFTLTISSLEPEDFAVYFCQQSSNDPFTFGQGTKLEIK |
| CL-27807 | 2129 | EIVLTQSPATLSLSPGERATLSCRASQSVSSLMHWYQQKPGQAPRLLIYGASCLESGIPARFSGSGSGTDFTLTISSLEPEDFAVYFCQQYXNDPYTFGQGTKLEIK |
| CL-27809 | 2130 | EIVLTQSPATLSLSPGERATLSCRASQSVITHMHWYQQKPGQAPRLLIYGASNLESGIPARFSGSGSGTDFTLTISSLEPEDFAVYYCQQRWKFPFTFGQGTKLEIK |
| CL-27810 | 2131 | EIVLTQSPATLSLSPGERATLSCRASESVSTQLAWYQQKPGQAPRLLIYGASNLESGVPARFSGSGSGTDFTLTISSLEPEDFAVYYCQQNWNNPLTFGQGTKLEIK |
| CL-27811 | 2132 | EIVLTQSPATLSLSPGERATLSCRASQSVSRDMHWYQQKPGQAPRLLIYGASYLESGIPARFSGSGSGTDFTLTISSLEPEDFAVYFCQQRWKEPFTFGQGTKLEIK |
| CL-27812 | 2133 | EIVLTQSPATLSLSPGERATLSCRASQSVTTLMHWYQQKPGQAPRLLIYGASNLESGIPARFSGSGSGTDFTLTISSLEPEDFAVYYCQQGCNDPLTFGQGTKLEIK |
| CL-27813 | 2134 | EIVLTQSPATLSLSPGERATLSCRASESVVTHMHWYQQKPGQAPRLLIYRASGLESGIPARFSGSGSGTDFTLTISSLEPEDFAVYYCQQSWQHPFTFGQGTKLEIK |
| CL-27814 | 2135 | EIVLTQSPATLSLSPGERATLSCRASESVSTHMHWYQQKPGQAPRLLIYGASNLESGIPARFSGSGSGTDFTLTISSLEPEDFAVYYCQQSGNDPCTFGQGTKLEIK |
| CL-27815 | 2136 | EIVLTQSPATLSLSPGERATLSCRASQSVNSYLAWYQQKPGQAPRLLIYWASNLESGVPARFSGSGSGTDFTLTISSLEPEDFAVYYCQQAWNDPSTFGQGTKLEIK |
| CL-27816 | 2137 | EIVLTQSPATLSLSPGERATLSCRASQSVSNPMHWYQQKPGQAPRLLIYGASNLESGVPARFSGSGSGTDFTLTISSLEPEDFAVYFCQQSWNDPFTFGQGTKLEIK |
| CL-27818 | 2138 | EIVLTQSPATLSLSPGERATLSCRASQSVSTLMHWYQQKPGQAPRLLIYGASNLESGVPARFSGSGSGTDFTLTISSLEPEDFAVYYCQQGLTDPFTFGQGTKLEIK |
| CL-27819 | 2139 | EIVLTQSPATLSLSPGERATLSCRASESVSPPLAWYQQKPGQAPRLLIYGASHLESGVPARFSGSGSGTDFTLTISSLEPEDFAVYFCQQSENDPLTFGQGTKLEIK |
| CL-27820 | 2140 | EIVLTQSPATLSLSPGERATLSCRASESVNTHMHWYQQKPGQAPRLLIYGASNLESGIPARFSGSGSGTDFTLTISSLEPEDFAVYFCQQTWNHPFTFGQGTKLEIK |
| CL-27821 | 2141 | EIVLTQSPATLSLSPGERATLSCRASESVSYPMHWYQQKPGQAPRLLIYGASRLESGIPARFSGSGSGTDFTLTISSLEPEDFAVYYCQQRWSDPFTFGQGTKLEIK |

TABLE 39-continued

List of Amino Acid Sequences of Affinity Matured H4q8.3 VL Variants

| Clone | SEQ ID NO: | VL |
|---|---|---|
| CL-27822 | 2142 | EIVLTQSPATLSLSPGERATLSCRASESVSTHMHWYQQKPGQAPRLLIYIASFLESGVPARFSGSGSGTDFTLTISSLEPEDFAVYYCQQSXFEPSTFGQGTKLEIK |
| CL-27823 | 2143 | EIVLTQSPATLSLSPGERATLSCRASESVSTQMHWYQQKPGQAPRLLIYGASYLESGIPARFSGSGSGTDFTLTISSLEPEDFAVYYCQQSWKDPFTFGQGTKLEIK |
| CL-27824 | 2144 | EIVLTQSPATLSLSPGERATLSCRASQSVSTKMHWYQQKPGQAPRLLIYRASNLESGIPARFSGSGSGTDFTLTISSLEPEDFAVYYCQQSWIDPFTFGQGTKLEIK |
| CL-27826 | 2145 | EIVLTQSPATLSLSPGERATLSCRASQSVGTHMHWYQQKPGQAPRLLIYRASYLESGIPARFSGSGSGTDFTLTISSLEPEDFAVYYCQQSWKDPFTFGQGTKLEIK |
| CL-27827 | 2146 | EIVLTQSPATLSLSPGERATLSCRASQSVMTHLAWYQQKPGQAPRLLIYGASNLESGVPARFSGSGSGTDFTLTISSLEPEDFAVYYCQQSWNEPFTFGQGTKLEIK |
| CL-27828 | 2147 | EIVLTQSPATLSLSPGERATLSCRASQSVXTHLAWYQQKPGQAPRLLIYGASKLESGIPARFSGSGSGTDFTLTISSLEPEDFAVYYCQQSWQDPITFGQGTKLEIK |
| CL-27833 | 2148 | EIVLTQSPATLSLSPGERATLSCRASQSVSTHMHWYQQKPGQAPRLLIYAASKLESGVPARFSGSGSGTDFTLTISSLEPEDFAVYXXQQSWNDPFTFGQGTKLEIK |
| CL-27838 | 2149 | EIVLTQSPATLSLSPGERATLSCRASQSVSSLMHWYQQKPGQAPRLLIYVASNLESGIPARFSGSGSGTDFTLTISSLEPEDFAVYYCQQSWNYPFTFGQGTKLEIK |
| CL-27840 | 2150 | EIVLTQSPATLSLSPGERATLSCRASQSVITPLAWYQQKPGQAPRLLIYGASRLESGVPARFSGSGSGTDFTLTISSLEPEDFAVYYCQQIWNDPFTFGQGTKLEIK |
| CL-27841 | 2151 | EIVLTQSPATLSLSPGERATLSCRASQSVSPLLAWYQQKPGQAPRLLIYGASNLESGIPARFSGSGSGTDFTLTISSLEPEDFAVYYCQQRWNEPFTFGQGTKLEIK |
| CL-27842 | 2152 | EIVLTQSPATLSLSPGERATLSCRASQSVNPHLAWYQQKPGQAPRLLIYWASSLESGVPARFSGSGSGTDFTLTISSLEPEDFAVYYCQQNWNDPFTFGQGTKLEIK |
| CL-27843 | 2153 | EIVLTQSPATLSLSPGERATLSCRASESVSTHMHWYQQKPGQAPRLLIYGASRLESGVPARFSGSGSGTDFTLTISSLEPEDFAVYYCQQGWNYPFTFGQGTKLEIK |
| CL-27844 | 2154 | EIVLTQSPATLSLSPGERATLSCRASQSVSTRMHWYQQKPGQAPRLLIYGASYLESGIPARFSGSGSGTDFTLTISSLEPEDFAVYYCQQTRYDPFTFGQGTKLEIK |
| CL-27845 | 2155 | EIVLTQSPATLSLSPGERATLSCRASESVSSHMHWYQQKPGQAPRLLIYGASRLESGVPARFSGSGSGTDFTLTISSLEPEDFAVYYCQQSWNDPFTFGQGTKLEIK |
| CL-27846 | 2156 | EIVLTQSPATLSLSPGERATLSCRASQSVTTHMHWYQQKPGQAPRLLIYAASNLESGIPARFSGSGSGTDFTLTISSLEPEDFAVYFCQQSWNHPFTFGQGTKLEIK |
| CL-27847 | 2157 | EIVLTQSPATLSLSPGERATLSCRASQSVKTQLAWYQQKPGQAPRLLIYGASNLESGIPARFSGSGSGTDFTLTISSLEPEDFAVYYCQQRCNGPFTFGQGTKLEIK |
| CL-27848 | 2158 | EIVLTQSPATLSLSPGERATLSCRASQSVSTQLAWYQQKPGQAPRLLIYGASHLESGVPARFSGSGSGTDFTLTISSLEPEDFAVYYCQQTGNDPFTFGQGTKLEIK |
| CL-27849 | 2159 | EIVLTQSPATLSLSPGERATLSCRASESVSPLMHWYQQKPGQAPRLLIYGASNLESGIPARFSGSGSGTDFTLTISSLEPEDFAVYFCQQSWKDPFTFGQGTKLEIK |

TABLE 39-continued

List of Amino Acid Sequences of Affinity Matured H4q8.3 VL Variants

| Clone | SEQ ID NO: | VL |
|---|---|---|
| CL-27850 | 2160 | EIVLTQSPATLSLSPGERATLSCRASESVSAHMHWYQQKPGQAPRLLIYGASKLESGVPARFSGSGSGTDFTLTISSLEPEDFAVYYCQQWWNNPFTFGQGTKLEIK |
| CL-27851 | 2161 | EIVLTQSPATLSLSPGERATLSCRASQSVNTHMHWYQQKPGQAPRLLIYRASNLESGVPARFSGSGSGTDFTLTISSLEPEDFAVYYCQQSWNEPLTFGQGTKLEIK |
| CL-29979 | 2162 | EIVLTQSPATLSLSPGERATLSCRASESVSTHMHWYQQKPGQAPRLLIYGASNLESGIPARFSGSGSGTDFTLTISSLEPEDFAVYFCQQSWQDPLTFGQGTKLEIK |
| CL-29980 | 2163 | EIVLTQSPATLSLSPGERATLSCRASQSVNTNMHWYQQKPGQAPRLLIYGASILESGIPARFSGSGSGTDFTLTISSLEPEDFAVYYCQQTWNVPFTFGQGTKLEIK |
| CL-29981 | 2164 | EIVLTQSPATLSLSPGERATLSCRASESVSTAMHWYQQKPGQAPRLLIYGASNLESGVPARFSGSGSGTDFTLTISSLEPEDFAVYFCQQTWNVPITFGQGTKLEIK |
| CL-29982 | 2165 | EIVLTQSPATLSLSPGERATLSCRASQSVSTHMHWYQQKPGQAPRLLIYGASMLESGVPARFSGSGSGTDFTLTISSLEPEDFAVYYCQQSWNDPLTFGQGTKLEIK |
| CL-29983 | 2166 | EIVLTQSPATLSLSPGERATLSCRASESVNDHMHWYQQKPGQAPRLLIYGASNLESGVPARFSGSGSGTDFTLTISSLEPEDFAVYYCQQSWNNPITFGQGTKLEIK |
| CL-29984 | 2167 | EIVLTQSPATLSLSPGERATLSCRASQSVGTHMHWYQQKPGQAPRLLIYGASYLESGVPARFSGSGSGTDFTLTISSLEPEDFAVYFCQQSWNDPLTFGQGTKLEIK |
| CL-29985 | 2168 | EIVLTQSPATLSLSPGERATLSCRASQSVSTHMHWYQQKPGQAPRLLIYGASILESGVPARFSGSGSGTDFTLTISSLEPEDFAVYFCQQTWDDPITFGQGTKLEIK |
| CL-29986 | 2169 | EIVLTQSPATLSLSPGERATLSCRASQSVGTHMHWYQQKPGQAPRLLIYGASKLESGVPARFSGSGSGTDFTLTISSLEPEDFAVYFCQQSFLDPITFGQGTKLEIK |
| CL-29987 | 2170 | EIVLTQSPATLSLSPGERATLSCRASESVSTNMHWYQQKPGQAPRLLIYGASILESGVPARFSGSGSGTDFTLTISSLEPEDFAVYYCQQGWSDPLTFGQGTKLEIK |
| CL-29988 | 2171 | EIVLTQSPATLSLSPGERATLSCRASESVSTHMHWYQQKPGQAPRLLIYGASNLESGVPARFSGSGSGTDFTLTISSLEPEDFAVYYCQQSWIDPLTFGQGTKLEIK |
| CL-29989 | 2172 | EIVLTQSPATLSLSPGERATLSCRASESVSTHMHWYQQKPGQAPRLLIYGASHLESGVPARFSGSGSGTDFTLTISSLEPEDFAVYYCQQSWIDPITFGQGTKLEIK |
| CL-29990 | 2173 | EIVLTQSPATLSLSPGERATLSCRASQSVGTHMHWYQQKPGQAPRLLIYGASNLESGVPARFSGSGCGTDFTLTISSLEPEDFAVYFCQQSWHDPLTFGQGTKLEIK |
| CL-29991 | 2174 | EIVLTQSPATLSLSPGERATLSCRASQSVSNHMHWYQQKPGQAPRLLIYGASILESGVPARFSGSGSGTDFTLTISSLEPEDFAVYFCQQTWDDPITFGQGTKLEIK |
| CL-29992 | 2175 | EIVLTQSPATLSLSPGERATLSCRASESVSTHMHWYQQKPGQAPRLLIYGASELESGVPARFSGSGSGTDFTLTISSLEPEDFAVYYCQQTWNDPITFGQGTKLEIK |
| CL-29993 | 2176 | EIVLTQSPATLSLSPGERATLSCRASESVNTLMHWYQQKPGQAPRLLIYGASHLESGIPARFSGSGSGTDFTLTISSLEPEDFAVYYCQQTWNEPITFGQGTKLEIK |
| CL-29994 | 2177 | EIVLTQSPATLSLSPGERATLSCRASESVSTHMHWYQQKPGQAPRLLIYGASNLESGIPARFSGSGSGTDFTLTISSLEPEDFAVYYCQQTWSDPLTFGQGTKLEIK |

TABLE 39-continued

List of Amino Acid Sequences of Affinity Matured H4g8.3 VL Variants

| Clone | SEQ ID NO: | VL |
|---|---|---|
| CL-29995 | 2178 | EIVLTQSPATLSLSPGERATLSCRASQSVSKHMHWYQQKPGQAPRLLIYGASNLESGIPARFSGSGSGTDFTLTISSLEPEDFAVYYCQQSWNNPITFGQGTKLEIK |
| CL-29996 | 2179 | EIVLTQSPATLSLSPGERATLSCRASQSVDTHMHWYQQKPGQAPRLLIYGASILESGVPARFSGSGSGTDFTLTISSLEPEDFAVYYCQQSWHDPITFGQGTKLEIK |
| CL-29997 | 2180 | EIVLTQSPATLSLSPGERATLSCRASESVSNHMHWYQQKPGQAPRLLIYGASKLESGVPARFSGSGSGTDFTLTISSLEPEDFAVYFCQQSWTDPLTFGQGTKLEIK |
| CL-29998 | 2181 | EIVLTQSPATLSLSPGERATLSCRASQSVSSHMHWYQQKPGQAPRLLIYGASHLESGVPARFSGSGSGTDFTLTISSLEPEDFAVYFCQQSWNDPLTFGQGTKLEIK |
| CL-29999 | 2182 | EIVLTQSPATLSLSPGERATLSCRASESVSTNMHWYQQKPGQAPRLLIYAASNLESGVPARFSGSGSGTDFTLTISSLEPEDFAVYFCQQSWNEPFTFGQGTKLEIK |
| CL-30000 | 2183 | EIVLTQSPATLSLSPGERATLSCRASQSVDTHMHWYQQKPGQAPRLLIYGASNLESGVPARFSGSGSGTDFTLTISSLEPEDFAVYYCQQSWGDPLTFGQGTKLEIK |
| CL-30001 | 2184 | EIVLTQSPATLSLSPGERATLSCRASESVSNNLAWYQQKPGQAPRLLIYGASHLESGIPARFSGSGSGTDFTLTISSLEPEDFAVYYCQQTWNDPITFGQGTKLEIK |
| CL-30002 | 2185 | EIVLTQSPATLSLSPGERATLSCRASQSVSNHMHWYQQKPGQAPRLLIYGASNLESGIPARFSGSGSGTDFTLTISSLEPEDFAVYYCQQSWNDPITFGQGTKLEIK |
| CL-30003 | 2186 | EIVLTQSPATLSLSPGERATLSCRASQSVGTHMHWYQQKPGQAPRLLIYGASNLESGVPARFSGSGSGTDFTLTISSLEPEDFAVYFCQQSWNEPWTFGQGTKLEIK |
| CL-30004 | 2187 | EIVLTQSPATLSLSPGERATLSCRASESVSTHMHWYQQKPGQAPRLLIYGASKLESGIPARFSGSGSGTDFTLTISSLEPEDFAVYYCQQSWIDPLTFGQGTKLEIK |
| CL-30005 | 2188 | EIVLTQSPATLSLSPGERATLSCRASQSVGNNMHWYQQKPGQAPRLLIYGASHLESGVPARFSGSGSGTDFTLTISSLEPEDFAVYYCQQSWNDPLTFGQGTKLEIK |
| CL-30006 | 2189 | EIVLTQSPATLSLSPGERATLSCRASQSVSTHMHWYQQKPGQAPRLLIYGASNLESGVPARFGGSGSGTDFTLTISSLEPEDFAVYYCQQSWTDPLTFGQGTKLEIK |
| CL-30007 | 2190 | EIVLTQSPATLSLSPGERATLSCRASESVYTXLAWYQQKPGQAPRLLIYGASNLESGVPARFSGSGSGTDFTLTISSLEPEDFAVYYCQQILNDPFTFGQGTKLEIK |
| CL-30009 | 2191 | EIVLTQSPATLSLSPGERATLSCRASQSVSNHMHWYQQKPGQAPRLLIYGASNLESGVPARFSGSGSGTDFTLTISSLEPEDFAVYYCQQSWNDPLTFGQGTKLEIK |
| CL-30010 | 2192 | EIVLTQSPATLSLSPGERATLSCRASQSVGTNMHWYQQKPGQAPRLLIYGASNLESGIPARFSGSGSGTDFTLTISSLEPEDFAVYFCQQSWNDPITFGQGTKLEIK |
| CL-30011 | 2193 | EIVLTQSPATLSLSPGERATLSCRASESVATHMHWYQQKPGQAPRLLIYGASYLESGVPARFSGSGSGTDFTLTISSLEPEDFAVYYCQQSWNDPLTFGQGTKLEIK |
| CL-30012 | 2194 | EIVLTQSPATLSLSPGERATLSCRASQSVSTHMHWYQQKPGQAPRLLIYGASHLESGIPARFSGSGSGTDFTLTISSLEPEDFAVYYCQQSWNDPLTFGQGTKLEIK |
| CL-30013 | 2195 | EIVLTQSPATLSLSPGERATLSCRASESVMNHLAWYQQKPGQAPRLLIYGASYLESGIPARFSGSGSGTDFTLTISSLEPEDFAVYYCQQTWSDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30014 | 2196 | EIVLTQSPATLSLSPGERATLSCRASQSVGTSMHWYQQKPGQAPRLLIYAASELESGIPARFSGSGSGTDFTLTISSLEPEDFAVYYCQQSWNDPFTFGQGTKLEIK |
| CL-30015 | 2197 | EIVLTQSPATLSLSPGERATLSCRASESVSTHMHWYQQKPGQAPRLLIYGASNLESGVPARFSGSGSGTDFTLTISSLEPEDFAVYFCQQSWNDPLTFGQGTKLEIK |
| CL-30017 | 2198 | EIVLTQSPATLSLSPGERATLSCRASESVSNNMHWYQQKPGQAPRLLIYGASNLESGIPARFSGSGSGTDFTLTISSLEPEDFAVYYCQQTWSDPFTFGQGTKLEIK |
| CL-30018 | 2199 | EIVLTQSPATLSLSPGERATLSCRASQSVSSHMHWYQQKPGQAPRLLIYGASKLESGIPARFSGSGSGTDFTLTISSLEPEDFAVYYCQQSFSDPITFGQGTKLEIK |
| CL-30019 | 2200 | EIVLTQSPATLSLSPGERATLSCRASESVSTHMHWYQQKPGQAPRLLIYGASHLESGIPARFSGSGSGTDFTLTISSLEPEDFAVYYCQQSWSDPLTFGQGTKLEIK |
| CL-30020 | 2201 | EIVLTQSPATLSLSPGERATLSCRASQSVSNHMHWYQQKPGQAPRLLIYGASHLESGIPARFSGSGSGTDFTLTISSLEPEDFAVYYCQQSWNDPLTFGQGTKLEIK |
| CL-30021 | 2202 | EIVLTQSPATLSLSPGERATLSCRASQSVSNHMHWYQQKPGQAPRLLIYGASNLESGIPARFSGSGSGTDFTLTISSLEPEDFAVYYCQQSWNPPITFGQGTKLEIK |
| CL-30022 | 2203 | EIVLTQSPATLSLSPGERATLSCRASESVSNHMHWYQQKPGQAPRLLIYGASNLESGVPARFSGSGSGTDFTLTISSLEPEDFAVYYCQQSWNEPFTFGQGTKLEIK |
| CL-30023 | 2204 | EIVLTQSPATLSLSPGERATLSCRASQSVGTNMHWYQQKPGQAPRLLIYGASILESGIPARFSGSGSGTDFTLTISSLEPEDFAVYYCQQTWNEPITFGQGTKLEIK |
| CL-30024 | 2205 | EIVLTQSPATLSLSPGERATLSCRASQSVSTHMHWYQQKPGQAPRLLIYGASNLESGVPARFSGSGSGTDFTLTISSLEPEDFAVYYCQQTWYDPVTFGQGTKLEIK |
| CL-30025 | 2206 | EIVLTQSPATLSLSPGERATLSCRASESVGTHMHWYQQKPGQAPRLLIYGASNLESGVPARFSGSGSGTDFTLTISSLEPEDFAVYFCQQTWNDPLTFGQGTKLEIK |
| CL-30026 | 2207 | EIVLTQSPATLSLSPGERATLSCRASQSVSSHMHWYQQKPGQAPRLLIYGASILESGVPARFSGSGSGTDFTLTISSLEPEDFAVYYCQQSWYDPLTFGQGTKLEIK |
| CL-30027 | 2208 | EIVLTQSPATLSLSPGERATLSCRASESVSTHMHWYQQKPGQAPRLLIYGASNLESGVPARFSGSGSGTDFTLTISSLEPEDFAVYYCQQSWYDPLTFGQGTKLEIK |
| CL-30028 | 2209 | EIVLTQSPATLSLSPGERATLSCRASESVSTHMHWYQQKPGQAPRLLIYGASNLESGVPARFSGSGSGTDFTLTISSLEPEDFAVYFCQQTWSDPLTFGQGTKLEIK |
| CL-30029 | 2210 | EIVLTQSPATLSLSPGERATLSCRASESVSTHMNWYQQKPGQAPRLLIYGASNLESGIPARFSGSGSGTDFTLTISSLEPEDFAVYYCQQSWNVPYTFGQGTKLEIK |
| CL-30030 | 2211 | EIVLTQSPATLSLSPGERATLSCRASESVTSNMHWYQQKPGQAPRLLIYAASILESGVPARFSGSGSGTDFTLTISSLEPEDFAVYYCQQSWQNPITFGQGTKLEIK |
| CL-30031 | 2212 | EIVLTQSPATLSLSPGERATLSCRASESVSDHMHWYQQKPGQAPRLLIYGASNLESGIPARFSGSGSGTDFTLTISSLEPEDFAVYYCQQSWTDPLTFGQGTKLEIK |
| CL-30032 | 2213 | EIVLTQSPATLSLSPGERATLSCRASESVSTHMHWYQQKPGQAPRLLIYGASNLESGVPARFSGSGSGTDFTLTISSLEPEDFAVYYCQQSWNDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30033 | 2214 | EIVLTQSPATLSLSPGERATLSCRASESVSNYMHWYQQKPGQAPRLLIYGASNLESGIPARFSGSGSGTDFTLTISSLEPEDFAVYYCQQSWTDPLTFGQGTKLEIK |
| CL-30034 | 2215 | EIVLTQSPATLSLSPGERATLSCRASQSVSTHMHWYQQKPGQAPRLLIYGASILESGIPARFSGSGSGTDFTLTISSLEPEDFAVYYCQQTWNDPITFGQGTKLEIK |
| CL-30035 | 2216 | EIVLTQSPATLSLSPGERATLSCRASQSVGTAMHWYQQKPGQAPRLLIYGASNLESGIPARFSGSGSGTDFTLTISSLEPEDFAVYFCQQSWDAPFTFGQGTKLEIK |
| CL-30036 | 2217 | EIVLTQSPATLSLSPGERATLSCRASQSVRSHMHWYQQKPGQAPRLLIYGASNLESGVPARFSGSGSGTDFTLTISSLEPEDFAVYYCQQSWTPPITFGQGTKLEIK |
| CL-30037 | 2218 | EIVLTQSPATLSLSPGERATLSCRASESVSTSMNWYQQKPGQAPRLLIYGASNLESGIPARFSGSGSGTDFTLTISSLEPEDFAVYYCQQSWKDPITFGQGTKLEIK |
| CL-30038 | 2219 | EIVLTQSPATLSLSPGERATLSCRASQSVSNHMHWYQQKPGQAPRLLIYGASNLESGVPARFSGSGSGTDFTLTISSLEPEDFAVYYCQQSWNVPWTFGQGTKLEIK |
| CL-30039 | 2220 | EIVLTQSPATLSLSPGERATLSCRASESVSNSMHWYQQKPGQAPRLLIYGASTLESGIPARFSGSGSGTDFTLTISSLEPEDFAVYFCQQTWTDPLTFGQGTKLEIK |
| CL-30040 | 2221 | EIVLTQSPATLSLSPGERATLSCRASESVGTHMHWYQQKPGQAPRLLIYGASNLESGIPARFSGSGSGTDFTLTISSLEPEDFAVYFCQQTWNDPSTFGQGTKLEIK |
| CL-30041 | 2222 | EIVLTQSPATLSLSPGERATLSCRASESVSTHMHWYQQKPGQAPRLLIYGASILESGVPARFSGSGSGTDFTLTISSLEPEDFAVYYCQQSWNDPLTFGQGTKLEIK |
| CL-30042 | 2223 | EIVLTQSPATLSLSPGERATLSCRASESVSTHMHWYQQKPGQAPRLLIYGASTLESGVPARFSGSGSGTDFTLTISSLEPEDFAVYYCQQSWSDPLTFGQGTKLEIK |
| CL-30043 | 2224 | EIVLTQSPATLSLSPGERATLSCRASESVDSNMHWYQQKPGQAPRLLIYRASILESGIPARFSGSGSGTDFTLTISSLEPEDFAVYYCQQTWGDPITFGQGTKLEIK |
| CL-30044 | 2225 | EIVLTQSPATLSLSPGERATLSCRASESVSTHMHWYQQKPGQAPRLLIYGASYLESGVPARFSGSGSGTDFTLTISSLEPEDFAVYYCQQSWNDPLTFGQGTKLEIK |
| CL-30045 | 2226 | EIVLTQSPATLSLSPGERATLSCRASESVSNHMHWYQQKPGQAPRLLIYGASYLESGIPARFSGSGSGTDFTLTISSLEPEDFAVYYCQQSWNDPLTFGQGTKLEIK |
| CL-30046 | 2227 | EIVLTQSPATLSLSPGERATLSCRASESVSDHMHWYQQKPGQAPRLLIYGASKLESGVPARFSGSGSGTDFTLTISSLEPEDFAVYYCQQSWTDPLTFGQGTKLEIK |
| CL-30047 | 2228 | EIVLTQSPATLSLSPGERATLSCRASESVGTHMHWYQQKPGQAPRLLIYGASNLESGIPARFSGSGSGTDFTLTISSLEPEDFAVYYCQQSWNDPLTFGQGTKLEIK |
| CL-30048 | 2229 | EIVLTQSPATLSLSPGERATLSCRASESVSTHMHWYQQKPGQAPRLLIYGASNLESGVPARFSGSGSGTDFTLTISSLEPEDFAVYYCQQTWSDPLTFGQGTKLEIK |
| CL-30049 | 2230 | EIVLTQSPATLSLSPGERATLSCRASESVNTHLAWYQQKPGQAPRLLIYGASMLESGVPARFSGSGSGTDFTLTISSLEPEDFAVYFCQQSWSLPYTFGQGTKLEIK |
| CL-30050 | 2231 | EIVLTQSPATLSLSPGERATLSCRASQSVSSHMHWYQQKPGQAPRLLIYGASNLESGVPARFSGSGSGTDFTLTISSLEPEDFAVYYCQQSWNDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30053 | 2232 | EIVLTQSPATLSLSPGERATLSCRASESVSTHMNWYQQKPGQAPRLLIYGASNLESGVPARFSGSGSGTDFTLTISSLEPEDFAVYFCQQSWNDPFTFGQGTKLEIK |
| CL-30054 | 2233 | EIVLTQSPATLSLSPGERATLSCRASESVGTHMHWYQQKPGQAPRLLIYGASNLESGVPARFSGSGSGTDFTLTISSLEPEDFAVYFCQQSWNEPYTFGQGTKLEIK |
| CL-30055 | 2234 | EIVLTQSPATLSLSPGERATLSCRASESVSTHMHWYQQKPGQAPRLLIYGASKLESGVPARFSGSGSGTDFTLTISSLEPEDFAVYYCQQTWGDPITFGQGTKLEIK |
| CL-30056 | 2235 | EIVLTQSPATLSLSPGERATLSCRASQSVSTNMHWYQQKPGQAPRLLIYAASNLESGVPARFSGSGSGTDFTLTISSLEPEDFAVYYCQQTWNEPITFGQGTKLEIK |
| CL-30057 | 2236 | EIVLTQSPATLSLSPGERATLSCRASESVGKHMHWYQQKPGQAPRLLIYGASKLESGIPARFSGSGSGTDFTLTISSLEPEDFAVYYCQQTWNDPITFGQGTKLEIK |
| CL-30058 | 2237 | EIVLTQSPATLSLSPGERATLSCRASESVSNHMHWYQQKPGQAPRLLIYGASFLESGVPARFSGSGSGTDFTLTISSLEPEDFAVYYCQQTWTNPITFGQGTKLEIK |
| CL-30059 | 2238 | EIVLTQSPATLSLSPGERATLSCRASQSVSTHMHWYQQKPGQAPRLLIYGASNLESGIPARFSGSGSGTDFTLTISSLEPEDFAVYFCQQSWDDPLTFGQGTKLEIK |
| CL-30060 | 2239 | EIVLTQSPATLSLSPGERATLSCRASESVGTHMHWYQQKPGQAPRLLIYGASYLESGIPARFSGSGSGTDFTLTISSLEPEDFAVYYCQQSWTDPITFGQGTKLEIK |
| CL-30061 | 2240 | EIVLTQSPATLSLSPGERATLSCRASQSVSTHMHWYQQKPGQAPRLLIYGASHLESGVPARFSGSGSGTDFTLTISSLEPEDFAVYYCQQSWIDPITFGQGTKLEIK |
| CL-30062 | 2241 | EIVLTQSPATLSLSPGERATLSCRASESVSTHMHWYQQKPGQAPRLLIYGASKLESGIPARFSGSGSGTDFTLTISSLEPEDFAVYYCQQSWNDPITFGQGTKLEIK |
| CL-30063 | 2242 | EIVLTQSPATLSLSPGERATLSCRASESVCTRMHWYQQKPGQAPRLLIYGASILESGVPARFSGSGSGTDFTLTISSLEPEDFAVYYCQQSWNDPYTFGQGTKLEIK |
| CL-30064 | 2243 | EIVLTQSPATLSLSPGERATLSCRASQSVSNHMHWYQQKPGQAPRLLIYGASNLESGVPARFSGSGSGTDFTLTISSLEPEDFAVYYCQQTFDDPLTFGQGTKLEIK |
| CL-30066 | 2244 | EIVLTQSPATLSLSPGERATLSCRASQSVGDSLAWYQQKPGQAPRLLIYAASNLESGVPARFSGSGSGTDFTLTISSLEPEDFAVYFCQQTWNVPITFGQGTKLEIK |
| CL-30067 | 2245 | EIVLTQSPATLSLSPGERATLSCRASESVANHLAWYQQKPGQAPRLLIYGASNLESGVPARFSGSGSGTDFTLTISSLEPEDFAVYYCQQSWYDPITFGQGTKLEIK |
| CL-30068 | 2246 | EIVLTQSPATLSLSPGERATLSCRASESVSTHMNWYQQKPGQAPRLLIYGASNLESGVPARFSGSGSGTDFTLTISSLEPEDFAVYYCQQGWYDPLTFGQGTKLEIK |
| CL-30069 | 2247 | EIVLTQSPATLSLSPGERATLSCRASESVSSHMHWYQQKPGQAPRLLIYGASILESGVPARFSGSGSGTDFTLTISSLEPEDFAVYYCQQSWNDPITFGQGTKLEIK |
| CL-30070 | 2248 | EIVLTQSPATLSLSPGERATLSCRASESVSTHMHWYQQKPGQAPRLLIYGASNLESGVPARFSGSGSGTDFTLTISSLEPEDFAVYFCQQSWNVPFTFGQGTKLEIK |
| CL-30071 | 2249 | EIVLTQSPATLSLSPGERATLSCRASESVNKHMHWYQQKPGQAPRLLIYGASNLESGVPARFSGSGSGTDFTLTISSLEPEDFAVYFCQQTWIDPFTFGQGTKLEIK |

TABLE 39-continued

List of Amino Acid Sequences of Affinity Matured H4q8.3 VL Variants

| Clone | SEQ ID NO: | VL |
|---|---|---|
| CL-30072 | 2250 | EIVLTQSPATLSLSPGERATLSCRASQSVGNHMHWYQQKPGQAPRLLIYGASNLESGVPARFSGSGSGTDFTLTISSLEPEDFAVYYCQQSWNMPITFGQGTKLEIK |
| CL-30073 | 2251 | EIVLTQSPATLSLSPGERATLSCRASESVGEHMHWYQQKPGQAPRLLIYAASNLESGVPARFSGSGSGTDFTLTISSLEPEDFAVYYCQQTWYDPLTFGQGTKLEIK |
| CL-30074 | 2252 | EIVLTQSPATLSLSPGERATLSCRASQSVSTHMHWYQQKPGQAPRLLIYGASNLESGVPARFSGSGSGTDFTLTISSLEPEDFAVYYCQQSWDVPLTFGQGTKLEIK |
| CL-30078 | 2253 | ENVLTQSPATLSLSPGERATLSCRASESVITHMNWYQQKPGQAPRLLIYGASILESGVPARFSGSGSGTDFTLTISSLEPEDFAVYYCQQSWNDPFTFGQGTKLEIK |
| CL-30090 | 2254 | EIVLTQSPATLSLSPGERATLSCRASQSVSNHMHWYQQKPGQAPRLLIYGASILESGVPARFSGSGSGTDFTLTISSLEPEDFAVYYCQQSWYDPLTFGQGTKLEIK |
| CL-30095 | 2255 | EIVLTQSPATLSLSPGERATLSCRASESVSNHMHWYQQKPGQAPRLLIYGASELESGIPARFSGSGSGTDFTLTISSLEPEDFAVYYCQQSWSDPLTFGQGTKLEIK |
| CL-30098 | 2256 | EIVLTQSPATLSLSPGERATLSCRASQSVDTHMHWYQQKPGQAPRLLIYGASHLESGIPARFSGSGSGTDFTLTISSLEPEDFAVYYCQQSWIDPITFGQGTKLEIK |
| CL-30099 | 2257 | EIVLTQSPATLSLSPGERATLSCRASQSVSTHMHWYQQKPGQAPRLLIYGASNLESGVPARFSGSGSGTDFTLTISSLEPEDFAVYYCQQSWIDPLTFGQGTKLEIK |
| CL-30103 | 2258 | EIVLTQSPATPSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| CL-30104 | 2259 | EIVLTQSPATLSLSPGERATLSCRASESVSSHMHWYQQKPGQAPRLLIYGASILESGIPARFSGSGSGTDFTLTISSLEPEDFAVYYCQQTWNDPITFGQGTKLEIK |
| CL-30106 | 2260 | EIVLTQSPATLSLSPGERATLSCRASQSVSNHMHWYQQKPGQAPRLLIYGASILESGVPARFSGSGSGTDFTLTISSLEPEDFAVYYCQQSWNDPLTFGQGTKLEIK |
| CL-30109 | 2261 | EIVLTQSPATLSLSPGERATLSCRASQSVITHMNWYQQKPGQAPRLLIYGASNLESGVPARFSGSGSGTDFTLTISSLEPEDFAVYYCQQTWNDPITFGQGTKLEIK |
| CL-30115 | 2262 | EIVLTQSPATLSLSPGERATLSCRASESVQTHMNWYQQKPGQAPRLLIYGASNLESGVPARFSGSGSGTDFTLTISSLEPEDFAVYYCQQSWNDPFTFGQGTKLEIK |
| CL-30120 | 2263 | EIVLTQSPATLSLSPGERATLSCRASQSVGTHMHWYQQKPGQAPRLLIYAASNLESGVPARFSGSGSGTDFTLTISSLEPEDFAVYYCQQTWYDPLTFGQGTKLEIK |
| CL-30121 | 2264 | EIVLTQSPATLSLSPGERATLSCRASESVSTHMHWYQQKPGQAPRLLIYGASILESGVPARFSGSGSGTDFTLTISSLEPEDFAVYFCQQSWNDPLTFGQGTKLEIK |
| CL-30123 | 2265 | EIVLTQSPATLSLSPGERATLSCRASESVITHMNWYQQKPGQAPRLLIYGASNLESGVPARFSGSGSGTDFTLTISSLEPEDFAVYFCQQSWDNPITFGQGTKLEIK |
| CL-30126 | 2266 | EIVLTQSPATLSLSPGERATLSCRASQSVHKHMNWYQQKPGQAPRLLIYGASNLESGVPARFSGSGSGTDFTLTISSLEPEDFAVYYCQQGWDDPLTFGQGTKLEIK |
| CL-30128 | 2267 | EIVLTQSPATLSLSPGERATLSCRASESVSTHMHWYQQKPGQAPRLLIYGASHLESGIPARFSGSGSGTDFTLTISSLEPEDFAVYYCQQSWNDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30131 | 2268 | EIVLTQSPATLSLSPGERATLSCRASESVLTHMNWYQQKPGQAPRLLIYGASNLESGIPARFSGSGSGTDFTLTISSLEPEDFAVYFCQQTWYEPWTFGQGTKLEIK |
| CL-30132 | 2269 | EIVLTQSPATLSLSPGERATLSCRASESVDTHMHWYQQKPGQAPRLLIYGASNLESGIPARFSGSGSGTDFTLTISSLEPEDFAVYYCQQTWYDPITFGQGTKLEIK |
| CL-30133 | 2270 | EIVLTQSPATLSLSPGERATLSCRASQSVSTHMHWYQQKPGQAPRLLIYGASILESGVPARFSGSGSGTDFTLTISSLEPEDFAVYYCQQTWSDPITFGQGTKLEIK |
| CL-30134 | 2271 | EIVLTQSPATLSLSPGERATLSCRASQSVGTHMNWYQQKPGQAPRLLIYGASFLESGIPARFSGSGSGTDFTLTISSLEPEDFAVYYCQQSWSDPITFGQGTKLEIK |
| CL-30135 | 2272 | EIVLTQSPATLSLSPGERATLSCRASQSVGTPMHWYQQKPGQAPRLLIYGASTLESGIPARFSGSGSGTDFTLTISSLEPEDFAVYYCQQTWYDPLTFGQGTKLEIK |
| CL-30137 | 2273 | EIVLTQSPATLSLSPGERATLSCRASESVSTHMHWYQQKPGQAPRLLIYGASYLESGIPARFSGSGSGTDFTLTISSLEPEDFAVYYCQQTWYDPITFGQGTKLEIK |
| CL-30143 | 2274 | EIVLTQSPATLSLSPGERATLSCRASESVDTHMHWYQQKPGQAPRLLIYGASILESGVPARFSGSGSGTDFTLTISSLEPEDFAVYYCQQTWYDPITFGQGTKLEIK |
| CL-30144 | 2275 | EIVLTQSPATLSLSPGERATLSCRASESVSTHMHWYQQKPGQAPRLLIYGASMLESGIPARFSGSGSGTDFTLTISSLEPEDFAVYFCQQTWTDPITFGQGTKLEIK |
| CL-30147 | 2276 | EIVLTQSPATLSLXPGERATLSCRASESVSTHMHWYQQKPGQAPRLLIYGASNLEYGVPARFSGSGCGTDFTLTISSIEHEDFAVYFCQQSWNDPFTFGQGTKLEIK |
| CL-30150 | 2277 | EIVLTQSPATLSLSPGERATLSCRASQSVANHLAWYQQKPGQAPRLLIYGASILESGVPARFSGSGSGTDFTLTISSLEPEDFAVYYCQQTWTDPITFGQGTKLEIK |
| CL-30152 | 2278 | EIVLTQSPATLSLSPGERATLSCRASESVSTHMHWYQQKPGQAPRLLIYGASMLESGVPARFSGSGSGTDFTLTISSLEPEDFAVYYCQQSWNNPITFGQGTKLEIK |
| CL-30155 | 2279 | EIVLTQSPATLSLSPGERATLSCRASQSVSNHMHWYQQKPGQAPRLLIYAASNLESGIPARFSGSGSGTDFTLTISSLEPEDFAVYYCQQSWDDPLTFGQGTKLEIK |
| CL-30158 | 2280 | EIVLTQSPATLSLSPGERVTLSCRASESVSTHMHWYQQKPGQAPRLLIYGASHLESGIPARFSGSGSGTDFTLTISSLEPEDFAVYYCQQSWNDPITFGQGTKLEIK |
| CL-30160 | 2281 | EIVLTQSPATLSLSPGERATLSCRASQSVSNHMHWYQQKPGQAPRLLIYAASNLESGVPARFSGSGSGTDFTLTISSLEPEDFAVYYCQQSWNDPLTFGQGTKLEIK |
| CL-30163 | 2282 | EIVLTQSPATLSLSPGERATLSCRASQSVSSHMHWYQQKPGQAPRLLIYAASKLESGVPARFSGSGSGTDFTLTISSLEPEDFAVYYCQQTWYDPLTFGQGTKLEIK |
| CL-30164 | 2283 | EIVLTQSPATLSLSPGERATLSCRASESVSTHMHWYQQKPGQAPRLLIYGASILESGVPARFSGSGSGTDFTLTISSLEPEDFAVYYCQQSWMDPITFGQGTKLEIK |
| CL-30166 | 2284 | EIVLTQSPATLSLSPGERATLSCRASESVSTNMHWYQQKPGQAPRLLIYGASILESGVPARFSGSGSGTDFTLTISSLEPEDFAVYFCQQSWSEPWTFGQGTKLEIK |
| CL-30167 | 2285 | EIVLTQSPATLSLSPGERATLSCRASQSVSTHMHWYQQKPGQAPRLLIYGASILESGVPARFSGSGSGTDFTLTISSLEPEDFAVYYCQQSWSDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30593 | 2286 | EIVLTQSPATLSLSPGERATLSCRASQSVDTHMHWYQQKPGQAPRLLIYGASNLESGVPARFSGSGSGTDFTLTISSLEPEDFAVYYCQQSWYDPLTFGQGTKLEIK |
| CL-30594 | 2287 | EIVLTQSPATLSLSPGERATLSCRASQSVSNHMHWYQQKPGQAPRLLIYGASNLESGVPARFSGSGSGTDFTLTISSLEPEDFAVYYCQQSWNEPFTFGQGTKLEIK |
| CL-30595 | 2288 | EIVLTQSPATLSLSPGERATLSCRASQSVSTHMHWYQQKPGQAPRLLIYGASHLESGIPARFSGSGSGTDFTLTISSLEPEDFAVYYCQQSWNDPITFGQGTKLEIK |
| CL-30597 | 2289 | EIVLTQSPATLSLSPGERATLSCRASESVSNHMHWYQQKPGQAPRLLIYGASTLESGVPARFSGSGSGTDFTLTISSLEPEDFAVYYCQQSWNDPLTFGQGTKLEIK |
| CL-30598 | 2290 | EIVLTQSPATLSLSPGERATLSCRASQSVSTHMHWYQQKPGQAPRLLIYGASVLESGVPARFSGSGSGTDFTLTISSLEPEDFAVYYCQQSWDDPLTFGQGTKLEIK |
| CL-30600 | 2291 | EIVLTQSPATLSLSPGERATLSCRASQSVSNHMHWYQQKPGQAPRLLIYGASNLESGIPARFSGSGSGTDFTLTISSLEPEDFAVYYCQQTWLDPITFGQGTKLEIK |
| CL-30601 | 2292 | EIVLTQSPATLSLSPGERATLSCRASQSVNTHLAWYQQKPGQAPRLLIYAASHLESGVPARFSGSGSGTDFTLTISSLEPEDFAVYFCQQTWTDPLTFGQGTKLEIK |
| CL-30602 | 2293 | EIVLTQSPATLSLSPGERATLSCRASQSVSTHMHWYQQKPGQAPRLLIYGASNLESGVPARFSGSGSGTDFTLTISSLEPEDFAVYYCQQSWSDPLTFGQGTKLEIK |
| CL-30604 | 2294 | EIVLTQSPATLSLSPGERATLSCRASQSVSNPMHWYQQKPGQAPRLLIYGASNLESGIPARFSGSGSGTDFTLTISSLEPEDFAVYYCQQSWNXPFTFGQGTKLEIK |
| CL-30606 | 2295 | EIVLTQSPATLSLSPGERATLSCRASESVSTHMHWYQQKPGQAPRLLIYGASKLESGVPARFSGSGSGTDFTLTISSLEPEDFAVYYCQQSWDDPFTFGQGTKLEIK |
| CL-30608 | 2296 | EIVLTQSPATLSLSPGERATLSCRASQSVGTHMHWYQQKPGQAPRLLIYGASNLESGIPARFSGSGSGTDFTLTISSLEPEDFAVYFCQQTWSDPLTFGQGTKLEIK |
| CL-30609 | 2297 | EIVLTQSPATLSLSPGERATLSCRASESVNSNMHWYQQKPGQAPRLLIYGASHLESGIPARFSGSGSGTDFTLTISSLEPEDFAVYFCQQSWYDPLTFGQGTKLEIK |
| CL-30610 | 2298 | EIVLTQSPATLSLSPGERATLSCRASQSVRNHMHWYQQKPGQAPRLLIYGASNLESGVPARFSGSGSGTDFTLTISSLEPEDFAVYFCQQSWDDPLTFGQGTKLEIK |
| CL-30611 | 2299 | EIVLTQSPATLSLSPGERATLSCRASESVSNHMHWYQQKPGQAPRLLIYGASNLESGIPARFSGSGSGTDFTLTISSLEPEDFAVYYCQQSWDDPLTFGQGTKLEIK |
| CL-30613 | 2300 | EIVLTQSPATLSLSPGERATLSCRASQSVNTAMHWYQQKPGQAPRLLIYGASSLESGIPARFSGSGSGTDFTLTISSLEPEDFAVYYCQQSWNDPLTFGQGTKLEIK |
| CL-30614 | 2301 | EIVLTQSPATLSLSPGERATLSCRASESVGSHMHWYQQKPGQAPRLLIYGASHLESGVPARFSGSGSGTDFTLTISSLEPEDFAVYYCQQSWNLPLTFGQGTKLEIK |
| CL-30615 | 2302 | EIVLTQSPATLSLSPGERATLSCRASESVSNHMHWYQQKPGQAPRLLIYGASNLESGVPARFSGSGSGTDFTLTISSLEPEDFAVYFCQQSWYDPITFGQGTKLEIK |
| CL-30616 | 2303 | EIVLTQSPATLSLSPGERATLSCRASQSVITHMNWYQQKPGQAPRLLIYGASNLESGVPARFSGSGSGTDFTLTISSLEPEDFAVYYCQQSWGDPWTFGQGTKLEIK |

TABLE 39-continued

List of Amino Acid Sequences of Affinity Matured H4q8.3 VL Variants

| Clone | SEQ ID NO: | VL |
|---|---|---|
| CL-30617 | 2304 | EIVLTQSPATLSLSPGERATLSCRASESVSTHMHWYQQKPGQAPRLLIYGASILESGVPARFSGSGSGTDFTLTISSLEPEDFAVYFCQQSWIDPLTFGQGTKLEIK |
| CL-30618 | 2305 | EIVLTQSPATLSLSPGERATLSCRASQSVGTHMHWYQQKPGQAPRLLIYGASMLESGIPARFSGSGSGTDFTLTISSLEPEDFAVYYCQQSWDDPLTFGQGTKLEIK |
| CL-30619 | 2306 | EIVLTQSPATLSLSPGERATLSCRASESVSTHMHWYQQKPGQAPRLLIYAASNLESGIPARFSGSGSGTDFTLTISSLEPEDFAVYYCQQSWYDPITFGQGTKLEIK |
| CL-30620 | 2307 | EIVLTQSPATLSLSPGERATLSCRASQSVSNHMHWYQQKPGQAPRLLIYGASNLESGVPARFSGSGSGTDFTLTISSLEPEDFAVYYCQQSWNDPITFGQGTKLEIK |
| CL-30624 | 2308 | EIVLTQSPATPSLSPGERATLSCRASESVGSCMHWYQQKPGQAPRLLIYGASNLESGIPARFSGSGSGTDFTLTISSLEPEDFAVYFCQQTWYDPLTFGQGTKLEIK |
| CL-30626 | 2309 | EIVLTQSPATLSLSPGERATLSCRASESVSTHMHWYQQKPGQAPRLLIYGASNLESGIPARFSGSGSGTDFTLTISSLEPEDFAVYFCQQSWNDPLTFGQGTKLEIK |
| CL-30627 | 2310 | EIVLTQSPATLSLSPGERATLSCRASQSVSTHMHWYQQKPGQAPRLLIYGASILESGVPARFSGSGSGTDFTLTISSLEPEDFAVYYCQQSWNDPLTFGQGTKLEIK |
| CL-30628 | 2311 | EIVLTQSPATLSLSPGERATLSCRASESVSRHMHWYQQKPGQAPRLLIYGASHLESGVPARFSGSGSGTDFTLTISSLEPEDFAVYYCQQSWNNPLTFGQGTKLEIK |
| CL-30629 | 2312 | EIVLTQSPATLSLSPGERATLSCRASESVSTHMHWYQQKPGQAPRLLIYGASNLESGIPARFSGSGSGTDFTLTISSLEPEDFAVYYCQQSWNDPATFGQGTKLEIK |
| CL-30630 | 2313 | EIVLTQSPATLSLSPGERATLSCRASQSVSTHMHWYQQKPGQAPRLLIYGASNLESGIPARFSGSGSGTDFTLTISSLEPEDFAVYYCQQSWNDPLTFGQGTKLEIK |
| CL-30631 | 2314 | EIVLTQSPATLSLSPGERATLSCRASQSVGRHMHWYQQKPGQAPRLLIYGASKLESGVPARFSGSGSGTDFTLTISSLEPEDFAVYYCQQTWTDPLTFGQGTKLEIK |
| CL-30632 | 2315 | EIVLTQSPATLSLSPGERATLSCRASQSVSTHMHWYQQKPGQAPRLLIYGASNLESGVPARFSGSGSGTDFTLTISSLEPEDFAVYFCQQSWSDPITFGQGTKLEIK |
| CL-30634 | 2316 | EIVLTQSPATLSLSPGERATLSCRASQSVSNHMHWYQQKPGQAPRLLIYGASNLESGIPARFSGSGSGTDFTLTISSLEPEDFAVYYCQQSWNDPLTFGQGTKLEIK |
| CL-30635 | 2317 | EIVLTQSPATLSLSPGERATLSCRASESVSSNMNWYQQKPGQAPRLLIYGASNLESGIPARFSGSGSGTDFTLTISSLEPEDFAVYYCQQSFYDPITFGQGTKLEIK |
| CL-30636 | 2318 | EIVLTQSPATLSLSPGERATLSCRASESVSSHMHWYQQKPGQAPRLLIYGASKLESGVPARFSGSGSGTDFTLTISSLEPEDFAVYYCQQSWSDPLTFGQGTKLEIK |
| CL-30637 | 2319 | EIVLTQSPATLSLSPGERATLSCRASESVSTHMHWYQQKPGQAPRLLIYGASHLESGVPARFSGSGSGTDFTLTISSLEPEDFAVYYCQQSWHDPLTFGQGTKLEIK |
| CL-30638 | 2320 | EIVLTQSPATLSLSPGERATLSCRASESVSNHMHWYQQKPGQAPRLLIYAASKLESGVPARFSGSGSGTDFTLTISSLEPEDFAVYYCQQTWIDPITFGQGTKLEIK |
| CL-30639 | 2321 | EIVLTQSPATLSLSPGERATLSCRASQSVSTHMHWYQQKPGQAPRLLIYGASKLESGVPARFSGSGSGTDFTLTISSLEPEDFAVYYCQQSWTDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30640 | 2322 | EIVLTQSPATLSLSPGERATLSCRASESVRSHLAWYQQKPGQAPRLLIYGASNLESGVPARFSGSGSGTDFTLTISSIEPEDFAVYFCQQSWNAPFTFGQGTKLEIK |
| CL-30641 | 2323 | EIVLTQSPATLSLSPGERATLSCRASQSVSNHMHWYQQKPGQAPRLLIYGASNLESGIPARFSGSGSGTDFTLTISSLEPEDFAVYFCQQSWSDPLTFGQGTKLEIK |
| CL-30642 | 2324 | EIVLTQSPATLSLSPGERATLSCRASESVSTHMHWYQQKPGQAPRLLIYGASILESGIPARFSGSGSGTDFTLTISSLEPEDFAVYYCQQTWDDPITFGQGTKLEIK |
| CL-30643 | 2325 | EIVLTQSPATLSLSPGERATLSCRASESVSNHMHWYQQKPGQAPRLLIYGASNLESGVPARFSGSGSGTDFTLTISSLEPEDFAVYYCQQSWNEPLTFGQGTKLEIK |
| CL-30644 | 2326 | EIVLTQSPATLSLSPGERATLSCRASESVSTHMPWYQQKPGQAPRLLIYGASILESGVPARFSGSGSGTDFTLTISSLEPEDFAVYYCQQSWNDPLTFGQGTKLEIK |
| CL-30645 | 2327 | EIVLTQSPATLSLSPGERATLSCRASESVSTHMHWYQQKPGQAPRLLIYGASNLESGVPARFSGSGSGTDFTLTISSLEPEDFAVYYCQQSWSDPLTFGQGTKLEIK |
| CL-30647 | 2328 | EIVLTQSPATLSLSPGERATLSCRASQSVSTAMHWYQQKPGQAPRLLIYGASNLESGIPARFSGSGSGTDFTLTISSLEPEDFAVYYCQQSWFDPLTFGQGTKLEIK |
| CL-30648 | 2329 | EIVLTQSPATLSLSPGERATLSCRASESVSNHMHWYQQKPGQAPRLLIYGASILESGIPARFSGSGSGTDFTLTISSLEPEDFAVYFCQQTWSDPITFGQGTKLEIK |
| CL-30649 | 2330 | EIVLTQSPATLSLSPGERATLSCRASESVNSDMHWYQQKPGQAPRLLIYGASNLESGVPARFSGSGSGTDFTLTISSLEPEDFAVYYCQQSWYDPLTFGQGTKLEIK |
| CL-30650 | 2331 | EIVLTQSPATLSLSPGERATLSCRASESVSNHMHWYQQKPGQAPRLLIYGASNLESGIPARFSGSGSGTDFTLTISSLEPEDFAVYYCQQSWNVPITFGQGTKLEIK |
| CL-30651 | 2332 | EIVLTQSPATLSLSPGERATLSCRASESVSTNLAWYQQKPGQAPRLLIYGASKLESGVPARFSGSGSGTDFTLTISSLEPEDFAVYFCQQTWNDPITFGQGTKLEIK |
| CL-30653 | 2333 | EIVLTQSPATLSLSPGERATLSCRASESVSNHMHWYQQKPGQAPRLLIYAASHLESGVPARFSGSGSGTDFTLTISSLEPEDFAVYYCQQSWTDPITFGQGTKLEIK |
| CL-30654 | 2334 | EIVLTQSPATLSLSPGERATLSCRASESVSTHMNWYQQKPGQAPRLLIYGASNLESGVPARFSGSGSGTDFTLTISSLEPEDFAVYYCQQSWTDPITFGQGTKLEIK |
| CL-30655 | 2335 | EIVLTQSPATLSLSPGERATLSCRASQSVSTHMHWYQQKPGQAPRLLIYGASNLESGIPARFSGSGSGTDFTLTISSLEPEDFAVYFCQQTWDVPFTFGQGTKLEIK |
| CL-30657 | 2336 | EIVLTQSPATLSLSPGERATLSCRASQSVSTHMHWYQQKPGQAPRLLIYGASNLESGVPARFSGSGSGTDFTLTISSLEPEDFAVYYCQQSWSDPITFGQGTKLEIK |
| CL-30658 | 2337 | EIVLTQSPATLSLSPGERATLSCRASQSVSTHMHWYQQKPGQAPRLLIYGASHLESGIPARFSGSGSGTDFTLTISSLEPEDFAVYYCQQCRNDPFTFGQGTKLEIK |
| CL-30659 | 2338 | EIVLTQSPATLSLSPGERATLSCRASESVSKHMNWYQQKPGQAPRLLIYGASNLESGVPARFSGSGSGTDFTLTISSLEPEDFAVYYCQQTWTDPLTFGQGTKLEIK |
| CL-30660 | 2339 | EIVLTQSPATLSLSPGERATLSCRASQSVSTHMHWYQQKPGQAPRLLIYGASRLESGVPARFSGSGSGTDFTLTISSLEPEDFAVYYCQQSWNDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30662 | 2340 | EIVLTQSPATLSLSPGERATLSCRASESVGTHMHWYQQKPGQAPRLLIYGASHLESGVPARFSGSGSGTDFTLTISSLEPEDFAVYCQQSWDDPLTFGQGTKLEIK |
| CL-30663 | 2341 | EIVLTQSPATLSLSPGERATLSCRASESVSTHMHWYQQKPGQAPRLLIYGASNLESGIPARFSGSGSGTDFTLTISSLEPEDFAVFCQQSWNEPYTFGQGTKLEIK |
| CL-30664 | 2342 | EIVLTQSPATLSLSPGERATLSCRASESVGMHMHWYQQKPGQAPRLLIYGASNLESGVPARFSGSGSGTDFTLTISSLEPEDFAVYCQQSWNDPLTFGQGTKLEIK |
| CL-30665 | 2343 | EIVLTQSPATLSLSPGERATLSCRASQSVSTHMNWYQQKPGQAPRLLIYAASNLESGVPARFSGSGSGTDFTLTISSLEPEDFAVYCQQSFNNPLTFGQGTKLEIK |
| CL-30666 | 2344 | EIVLTQSPATLSLSPGERATLSCRASQSVNTHLHWYQQKPGQAPRLLIYGASNLESGVPARFSGSGSGTDFTLTISSLEPEDFAVYCQQSWFDPLTFGQGTKLEIK |
| CL-30667 | 2345 | EIVLTQSPATLSLSPGERATLSCRASQSVGTHMHWYQQKPGQAPRLLIYGASILESGVPARFSGSGSGTDFTLTISSLEPEDFAVFCQQSWNDPLTFGQGTKLEIK |
| CL-30669 | 2346 | EIVLTQSPATLSLSPGERATLSCRASESVSNHMHWYQQKPGQAPRLLIYGASNLESGVPARFSGSGSGTDFTLTISSLEPEDFAVFCQQSWYDPLTFGQGTKLEIK |
| CL-30670 | 2347 | EIVLTQSPATLSLSPGERATLSCRASQSVSNHMHWYQQKPGQAPRLLIYGASNLESGIPARFSGSGSGTDFTLTISSLEPEDFAVYCQQSWLDPLTFGQGTKLEIK |
| CL-30671 | 2348 | EIVLTQSPATLSLSPGERATLSCRASESVSNHMHWYQQKPGQAPRLLIYGASILESGVLARFSGSGSGTDFTLTISSLEPEDFAVYCQQSWNDPLTFGQGTKLEIK |
| CL-30672 | 2349 | EIVLTQSPATLSLSPGERATLSCRASESVSSHMHWYQQKPGQAPRLLIYGASNLESGIPARFSGSGSGTDFTLTISSLEPEDFAVYCQQTWNYPITFGQGTKLEIK |
| CL-30673 | 2350 | EIVLTQSPATLSLSPGERATLSCRASQSVSTHMHWYQQKPGQAPRLLIYGASNLESGIPARFSGSGSGTDFTLTISSLEPEDFAVYCQQTWYDPITFGQGTKLEIK |
| CL-30674 | 2351 | EIVLTQSPATLSLSPGERATLSCRASESVGNHMHWYQQKPGQAPRLLIYGASNLESGIPARFSGSGSGTDFTLTISSLEPEDFAVYCQQSWIDPLTFGQGTKLEIK |
| CL-30675 | 2352 | EIVLTQSPATLSLSPGERATLSCRASESVSNHMHWYQQKPGQAPRLLIYAASKLESGIPARFSGSGSGTDFTLTISSLEPEDFAVFCQQSWVEPFTFGQGTKLEIK |
| CL-30676 | 2353 | EIVLTQSPATLSLSPGERATLSCRASQSVETHMHWYQQKPGQAPRLLIYGASHLESGVPARFSGSGSGTDFTLTISSLEPEDFAVYCQQSWRDPLTFGQGTKLEIK |
| CL-30677 | 2354 | EIVLTQSPATLSLSPGERATLSCRASQSVSTHMNWYQQKPGQAPRLLIYGASHLESGIPARFSGSGSGTDFTLTISSLEPEDFAVFCQQSWDDPLTFGQGTKLEIK |
| CL-30678 | 2355 | EIVLTQSPATLSLSPGERATLSCRASQSVGSSMHWYQQKPGQAPRLLIYGASKLESGVPARFSGSGSGTDFTLTISSLEPEDFAVFCQQSWNDPLTFGQGTKLEIK |
| CL-30679 | 2356 | EIVLTQSPATLSLSPGERATLSCRASESVSTHMHWYQQKPGQAPRLLIYGASNLESGIPARFSGSGSGTDFTLTISSLEPEDFAVYCQQSWNDPLTFGQGTKLEIK |
| CL-30681 | 2357 | EIVLTQSPATLSLSPGERATLSCRASQSVTNHMHWYQQKPGQAPRLLIYGASNLESGVPARFSGSGSGTDFTLTISSLEPEDFAVYCQQSWHDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-30682 | 2358 | EIVLTQSPATLSLSPGERATLSCRASESVSSHLAWYQQKPGQAPRLLIYGASTLESGIPARFSGSGSGTDFTLTISSLEPEDFAVYYCQQSWGDPFTFGQGTKLEIK |
| CL-30683 | 2359 | EIVLTQSPATLSLSPGERATLSCRASQSVSNHMHWYQQKPGQAPRLLIYGASNLESGIPARFSGSGSGTDFTLTISSLEPEDFAVYYCQQSWSDPLTFGQGTKLEIK |
| CL-30684 | 2360 | EIVLTQSPATLSLSPGERATLSCRASESVHDHMHWYQQKPGQAPRLLIYAASHLESGVPARFSGSGSGTDFTLTISSLEPEDFAVYYCQQSWNDPLTFGQGTKLEIK |
| CL-30685 | 2361 | EIVLTQSPATLSLSPGERATLSCRASQSVSTHMHWYQQKPGQAPRLLIYGASNLESGIPARFSGSGSGTDFTLTISSLEPEDFAVYYCQQSWADPLTFGQGTKLEIK |
| CL-34444 | 2362 | EIVLTQSPATLSLSPGERATLSCRASQSVGTHMHWYQQKPGQAPRLLIYGASILESGIPARFSGSGSGTDFTLTISSLEPEDFAVYYCQQSWYDPLTFGQGTKLEIK |
| CL-34445 | 2363 | EIVLTQSPATLSLSPGERATLSCRASESVSTHMHWYQQKPGQAPRLLIYGASHLESGVPARFSGSGSGTDFTLTISSLEPEDFAVYYCQQSWNDPFTFGQGTKLEIK |
| CL-34446 | 2364 | EIVLTQSPATLSLSPGERATLSCRASESVSNHMHWYQQKPGQAPRLLIYGASNLESGVPARFSGSGSGTDFTLTISSLEPEDFAVYYCQQSFYDPLTFGQGTKLEIK |
| CL-34447 | 2365 | EIVLTQSPATLSLSPGERATLSCRASESVGTHMHWYQQKPGQAPRLLIYGASNLESGIPARFSGSGSGTDFTLTISSLEPEDFAVYYCQQSWYDPLTFGQGTKLEIK |
| CL-34448 | 2366 | EIVLTQSPATLSLSPGERATLSCRASQSVSTHMHWYQQKPGQAPRLLIYGASMLESGIPARFSGSGSGTDFTLTISSLEPEDFAVYYCQQSWMDPITFGQGTKLEIK |
| CL-34450 | 2367 | EIVLTQSPATLSLSPGERATLSCRASESVSTHMHWYQQKPGQAPRLLIYGASNLESGVPARFSGSGSGTDFTLTISSLEPEDFAVYYCQQSWMDPLTFGQGTKLEIK |
| CL-34451 | 2368 | EIVLTQSPATLSLSPGERATLSCRASESVSNHMHWYQQKPGQAPRLLIYGASILESGIPARFSGSGSGTDFTLTISSLEPEDFAVYYCQQSWYDPLTFGQGTKLEIK |
| CL-34452 | 2369 | EIVLTQSPATLSLSPGERATLSCRASESVGTHMHWYQQKPGQAPRLLIYGASNLESGIPARFSGSGSGTDFTLTISSLEPEDFAVYYCQQSWHDPLTFGQGTKLEIK |
| CL-34453 | 2370 | EIVLTQSPATLSLSPGERATLSCRASESVSTHMHWYQQKPGQAPRLLIYGASNLESGVPARFSGSGSGTDFTLTISSLEPEDFAVYYCQQSFTNPLTFGQGTKLEIK |
| CL-34454 | 2371 | EIVLTQSPATLSLSPGERATLSCRASQSVSTHMHWYQQKPGQAPRLLIYGASILESGVPARFSGSGSGTDFTLTISSLEPEDFAVYYCQQSWYDPLTFGQGTKLEIK |
| CL-34457 | 2372 | EIVLTQSPATLSLSPGERATLSCRASXSVNTHMHWYQQKPGQAPRLLIYGASXLESGVPARFSGSGSGTDFTLTISSLEPEDFAVYFCQQXWYDPITFGQGTKLEIK |
| CL-34458 | 2373 | EIVLTQSPATLSLSPGERATLSCRASESVRTHMHWYQQKPGQAPRLLIYGASNLESGVPARFSGSGSGTDFTLTISSLEPEDFAVYYCQQSWYDPLTFGQGTKLEIK |
| CL-34459 | 2374 | EIVLTQSPATLSLSPGERATLSCRASQSVGTHMHWYQQKPGQAPRLLIYGASNLESGVPARFSGSGSGTDFTLTISSLEPEDFAVYYCQQTWYDPLTFGQGTKLEIK |
| CL-34460 | 2375 | EIVLTQSPATLSLSPGERATLSCRASESVSTHMHWYQQKPGQAPRLLIYGASHLESGVPARFSGSGSGTDFTLTISSLEPEDFAVYYCQQSWYDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-34461 | 2376 | EIVLTQSPATLSLSPGERATLSCRASESVSTHMHWYQQKPGQAPRLLIYGASHLESGIPARFSGSGSGTDFTLTISSLEPEDFAVYYCQQSWYDPLTFGQGTKLEIK |
| CL-34462 | 2377 | EIVLTQSPATLSLSPGERATLSCRASQSVSTHMHWYQQKPGQAPRLLIYGASVLESGVPARFSGSGSGTDFTLTISSLEPEDFAVYYCQQSWYDPLTFGQGTKLEIK |
| CL-34464 | 2378 | EIVLTQSPATLSLSPGERATLSCRASQSVSRHMHWYQQKPGQAPRLLIYGASNLESGIPARFSGSGSGTDFTLTISSLEPEDFAVYYCQQSWYDPITFGQGTKLEIK |
| CL-34465 | 2379 | EIVLTQSPATLSLSPGERATLSCRASQSVSSHMHWYQQKPGQAPRLLIYGASILESGIPARFSGSGSGTDFTLTISSLEPEDFAVYYCQQTWDDPITFGQGTKLEIK |
| CL-34467 | 2380 | EIVLTQSPATLSLSPGERATLSCRASESVSTSMHWYQQKPGQAPRLLIYGASQLESGVPARFSGSGSGTDFTLTISSLEPEDFAVYYCQQSWNVPFTFGQGTKLEIK |
| CL-34468 | 2381 | EIVLTQSPATLSLSPGERATLSCRASESVGTHMHWYQQKPGQAPRLLIYGASRLESGIPARFSGSGSGTDFTLTISSLEPEDFAVYYCQQSWTVPLTFGQGTKLEIK |
| CL-34472 | 2382 | EIVLTQSPATLSLSPGERATLSCRASQSVGTHMHWYQQKPGQAPRLLIYGASHLESGVPARFSGSGSGTDFTLTISSLEPEDFAVYYCQQTWYDPLTFGQGTKLEIK |
| CL-34473 | 2383 | EIVLTQSPATLSLSPGERATLSCRASQSVSTHMHWYQQKPGQAPRLLIYGASVLESGVPARFSGSGSGTDFTLTISSLEPEDFAVYFCQQSWYDPLTFGQGTKLEIK |
| CL-34474 | 2384 | EIVLTQSPATLSLSPGERATLSCRASQSVSTHMHWYQQKPGQAPRLLIYGASTLESGIPARFSGSGSGTDFTLTISSLEPEDFAVYFCQQSWYDPLTFGQGTKLEIK |
| CL-34478 | 2385 | EIVLTQSPATLSLSPGERATLSCRASQSVGTHMHWYQQKPGQAPRLLIYGASYLESGVPARFSGSGSGTDFTLTISSLEPEDFAVYFCQQTWYDPLTFGQGTKLEIK |
| CL-34479 | 2386 | EIVLTQSPATLSLSPGERATLSCRASQSVSTHMHWYQQKPGQAPRLLIYGASTLESGVPARFSGSGSGTDFTLTISSLEPEDFAVYYCQQTWYDPLTFGQGTKLEIK |
| CL-34480 | 2387 | EIVLTQSPATLSLSPGERATLSCRASQSVGTHMHWYQQKPGQAPRLLIYGASILESGVPARFSGSGSGTDFTLTISSLEPEDFAVYYCQQSWYDPLTFGQGTKLEIK |
| CL-34481 | 2388 | EIVLTQSPATLSLSPGERATLSCRASQSVNNHMHWYQQKPGQAPRLLIYGASNLESGVPARFSGSGSGTDFTLTISSLEPEDFAVYYCQQSWYDPLTFGQGTKLEIK |
| CL-34482 | 2389 | EIVLTQSPATLSLSPGERATLSCRASQSVGEHMHWYQQKPGQAPRLLIYGASHLESGVPARFSGSGSGTDFTLTISSLEPEDFAVYYCQQSWYDPITFGQGTKLEIK |
| CL-34485 | 2390 | EIVLTQSPATLSLSPGERATLSCRASQSVSTHMHWYQQKPGQAPRLLIYGASHLESGVPARFSGSGSGTDFTLTISSLEPEDFAVYYCQQTWYDPLTFGQGTKLEIK |
| CL-34487 | 2391 | EIVLTQSPATLSLSPGERATLSCRASQSVSTNMHWYQQKPGQAPRLLIYGASILESGVPARFSGSGSGTDFTLTISSLEPEDFAVYFCQQTWYDPITFGQGTKLEIK |
| CL-34488 | 2392 | EIVLTQSPATLSLSPGERATLSCRASESVGTHMHWYQQKPGQAPRLLIYGASTLESGIPARFSGSGSGTDFTLTISSLEPEDFAVYYCQQSWYDPLTFGQGTKLEIK |
| CL-34490 | 2393 | EIVLTQSPATLSLSPGERATLSCRASQSVSNHMHWYQQKPGQAPRLLIYGASNLESGVPARFSGSGSGTDFTLTISSLEPEDFAVYFCQQSWYDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-34494 | 2394 | EIVLTQSPATLSLSPGERATLSCRASQSVGSHMHWYQQKPGQAPRLLIYGASILESGVPARFSGSGSGTDFTLTISSLEPEDFAVYFCQQSWYDPITFGQGTKLEIK |
| CL-34496 | 2395 | EIVLTQSPATLSLSPGERATLSCRASQSVGNHMHWYQQKPGQAPRLLIYGASNLESGVPARFSGSGSGTDFTLTISSLEPEDFAVYFCQQSWYDPLTFGQGTKLEIK |
| CL-34498 | 2396 | EIVLTQSPATLSLSPGERATLSCRASESVGTHMHWYQQKPGQAPRLLIYGASNLESGIPARFSGSGSGTDFTLTISSLEPEDFAVYYCQQTWYDPLTFGQGTKLEIK |
| CL-34499 | 2397 | EIVLTQSPATLSLSPGERATLSCRASQSVSTHMHWYQQKPGQAPRLLIYGASNLESGVPARFSGSGSGTDFTLTISSLEPEDFAVYFCQQSWYDPITFGQGTKLEIK |
| CL-34500 | 2398 | EIVLTQSPATLSLSPGERATLSCRASESVGTHMHWYQQKPGQAPRLLIYGASHLESGIPARFSGSGSGTDFTLTISSLEPEDFAVYYCQQSWYDPITFGQGTKLEIK |
| CL-34502 | 2399 | EIVLTQSPATLSLSPGERATLSCRASESVSTHMHWYQQKPGQAPRLLIYGASKLESGVPARFSGSGSGTDFTLTISSLEPEDFAVYYCQQSWYDPLTFGQGTKLEIK |
| CL-34504 | 2400 | EIVLTQSPATLSLSPGERATLSCRASESVSRHMNWYQQKPGQAPRLLIYGASNLESGIPARFSGSGSGTDFTLTISSLEPEDFAVYFCQQTWYDPITFGQGTNLEIK |
| CL-34505 | 2401 | EIVLTQSPATLSLSPGERATLSCRASQSVGTHMHWYQQKPGQAPRLLIYGASYLESGIPARFSGSGSGTDFTLTISSLEPEDFAVYYCQQTWYDPITFGQGTKLEIK |
| CL-34506 | 2402 | EIVLTQSPATLSLSPGERATLSCRASQSVGTHMHWYQQKPGQAPRLLIYGASNLESGVPARFSGSGSGTDFTLTISSLEPEDFAVYFCQQSWYDPITFGQGTKLEIK |
| CL-34508 | 2403 | EIVLTQSPATLSLSPGERATLSCRASESVDTHMHWYQQKPGQAPRLLIYGASNLESGVPARFSGSGSGTDFTLTISSLEPEDFAVYYCQQSWYDPLTFGQGTKLEIK |
| CL-34509 | 2404 | EIVLTQSPATLSLSPGERATLSCRASQSVSNHMHWYQQKPGQAPRLLIYGASNLESGVPARFSGSGSGTDFTLTISSLEPEDFAVYYCQQSWYDPITFGQGTKLEIK |
| CL-34511 | 2405 | EIVLTQSPATLSLSPGERATLSCRASESVSTHMHWYQQKPGQAPRLLIYGASNLESGIPARFSGSGSGTDFTLTISSLEPEDFAVYYCQQSWYDPLTFGQGTKLEIK |
| CL-34512 | 2406 | EIVLTQSPATLSLSPGERATLSCRASQSVGTHMHWYQQKPGQAPRLLIYGASNLESGVPARFSGSGSGTDFTLTISSLEPEDFAVYYCQQSWYDPLTFGQGTKLEIK |
| CL-34514 | 2407 | EIVLTQSPATLSLSPGERATLSCRASQSVSTHMHWYQQKPGQAPRLLIYGASILESGIPARFSGSGSGTDFTLTISSLEPEDFAVYYCQQSWYDPLTFGQGTKLEIK |
| CL-34515 | 2408 | EIVLTQSPATLSLSPGERATLSCRASQSVSTHMHWYQQKPGQAPRLLIYGASNLESGIPARFSGSGSGTDFTLTISSLEPEDFAVYFCQQTWYDPITFGQGTKLEIK |
| CL-34517 | 2409 | EIVLTQSPATLSLSPGERATLSCRASESVGTHMHWYQQKPGQAPRLLIYGASNLESGVPARFSGSGSGTDFTLTISSLEPEDFAVYYCQQSWYDPLTFGQGTKLEIK |
| CL-34520 | 2410 | EIVLTQSPATLSLSPGERATLSCRASESVGTHMHWYQQKPGQAPRLLIYGASILESGIPARFSGSGSGTDFTLTISSLEPEDFAVYFCQQSWYDPLTFGQGTKLEIK |
| CL-34521 | 2411 | EIVLTQSPATLSLSPGERATLSCRASESVDRHMHWYQQKPGQAPRLLIYGASHLESGVPARFSGSGSGTDFTLTISSLEPEDFAVYYCQQTWYDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-34523 | 2412 | EIVLTQSPATLSLSPGERATLSCRASQSVTNHMHWYQQKPGQA PRLLIYGASVLESGIPARFSGSGSGTDFTLTISSLEPEDFAVY YCQQSWYDPLTFGQGTKLEIK |
| CL-34524 | 2413 | EIVLTQSPATLSLSPGERATLSCRASESVSTHMHWYQQKPGQA PRLLIYGASNLESGVPARFSGSGSGTDFTLTISSLEPEDFAVY YCQQSWYDPITFGQGTKLEIK |
| CL-34525 | 2414 | EIVLTQSPATLSLSPGERATLSCRASESVSNHMHWYQQKPGQA PRLLIYGASNLESGVPARFSGSGSGTDFTLTISSLEPEDFAVY YCQQTWYDPITFGQGTKLEIK |
| CL-34526 | 2415 | EIVLTQSPATLSLSPGERATLSCRASESVSTHMHWYQQKPGQA PRLLIYGASNLESGIPARFSGSGSGTDFTLTISSLEPEDFAVY YCQQTWYDPLTFGQGTKLEIK |
| CL-34529 | 2416 | EIVLTQSPATLYLXPGERATLSCRASQSVSTHMHWYQQKPGQA ARLVMYGASNLEFGVPARFSGSGSGTEFTLTISSLEPEDFAVY YCQQSWYDPLTFGQGTKLEIK |
| CL-34533 | 2417 | EIVLTQSPATLSLSPGERATLSCRASQSVSTHMHWYQQKPGQA PRLLIYGASNLESGVPARFSGSGSGTDFTLTISSLEPEDFAVY YCQQSWYDPITFGQGTKLEIK |
| CL-34534 | 2418 | EIVLTQSPATLSLSPGERATLSCRASQSVGTHMHWYQQKPGQA PRLLIYGASHLESGIPARFSGSGSGTDFTLTISSLEPEDFAVY YCQQSWYDPLTFGQGTKLEIK |
| CL-34536 | 2419 | EIVLTQSPATLSLSPGERATLSCRASQSVGAHMHWYQQKPGQA PRLLIYGASNLESGVPARFSGSGSGTDFTLTISSLEPEDFAVY YCQQTWYDPLTFGQGTKLEIK |
| CL-34539 | 2420 | EIVLTQSPATLSLSPGERATLSCRASQSVSTHMHWYQQKPGQA PRLLIYGASNLESGIPARFSGSGSGTDFTLTISSLEPEDFAVY YCQQSWSDPLTFGQGTKLEIK |
| CL-34541 | 2421 | EIVLTQSPATLSLSPGERATLSCRASQSVSTHMHWYQQKPGQA PRLLIYGASILESGIPARFSGSGSGTDFTLTISSLEPEDFAVY YCQQSWYDPITFGQGTKLEIK |
| CL-34548 | 2422 | EIVLTQSPATLSLSPGERATLSCRASQSVSNHMHWYQQKPGQA PRLLIYGASHLESGVPARFSGSGSGTDFTLTISSLEPEDFAVY YCQQSWYDPLTFGQGTKLEIK |
| CL-34556 | 2423 | EIVLTQSPATLSLSPGERATLSCRASESVSXHMHWYQQKPGQA PRLLIYGASILESGVPARFSGSGSGTDFTLTISSLEPEDFAVY YCQQSWYDPLTFGQGTKLEIK |
| CL-34558 | 2424 | EIVLTQSPATLSLSPGERATLSCRASESVSTAMHWYQQKPGQA PRLLIYAASILESGVPARFSGSGSGTDFTLTISSLEPEDFAVY YCQQSWYDPLTFGQGTKLEIK |
| CL-34561 | 2425 | EIVLTQSPATLSLSPGERATLSCRASESVGTHMHWYQQKPGQA PRLLIYGASYLESGVPARFSGSGSGTDFTLTISSLEPEDFAVY YCQQTWYDPITFGQGTKLEIK |
| CL-34562 | 2426 | EIVLTQSPATLSLSPGERATLSCRASQSVGSHMHWYQQKPGQA PRLLIYGASNLESGIPARFSGSGSGTDFTLTISSLEPEDFAVY YCQQTWYDPLTFGQGTKLEIK |
| CL-34563 | 2427 | EIVLTQSPATLSLSPGERATLSCRASESVSTHMHWYQQKPGQA PRLLIYGASILESGVPARFSGSGSGTDFTLTISSLEPEDFAVY FCQQSWYDPLTFGQGTKLEIK |
| CL-34566 | 2428 | EIVLTQSPATLSLSPGERATLSCRASQSVGTNMHWYQQKPGQA PRLLIYGASVLESGIPARFSGSGSGTDFTLTISSLEPEDFAVY FCQQTWYDPITFGQGTKLEIK |
| CL-34568 | 2429 | EIVLTQSPATLSLSPGERATLSCRASESVGKHMHWYQQKPGQA PRLLIYGASHLESGVPARFSGSGSGTDFTLTISSLEPEDFAVY YCQQSWMDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-34573 | 2430 | EIVLTQSPATLSLSPGERATLSCRASQSVSTHMHWYQQKPGQAPRLLIYGASFLESGVPARFSGSGSGTDFTLTISSLEPEDFAVYYCQQSWYDPLTFGQGTKLEIK |
| CL-34574 | 2431 | EIVLTQSPATLSLSPGERATLSCRASESVGTHMHWYQQKPGQAPRLLIYGASNLESGIPARFSGSGSGTDFTLTISSLEPEDFAVYYCQQSWGDPLTFGQGTKLEIK |
| CL-34577 | 2432 | EIVLTQSPATLSLSPGERATLSCRASESVSKHMHWYQQKPGQAPRLLIYGASHLESGIPARFSGSGSGTDFTLTISSLEPEDFAVYYCQQSWYDPLTFGQGTKLEIK |
| CL-34580 | 2433 | EIVLTQSPATLSLSPGERATLSCRASESVSTHMHWYQQKPGQAPRLLIYGASMLESGIPARFSGSGSGTDFTLTISSLEPEDFAVYYCQQTWDDPLTFGQGTKLEIK |
| CL-34582 | 2434 | EIVLTQSPATLSLSPGERATLSCRASQSVGTHMHWYQQKPGQAPRLLIYGASNLESGIPARFSGSGSGTDFTLTISSLEPEDFAVYYCQQSWYDPLTFGQGTKLEIK |
| CL-34585 | 2435 | EIVLTQSPATLSLSPGERATLSCRASESVSTHMHWYQQKPGQAPRLLIYGASNLESGVPARFSGSGSGTDFTLTISSLEPEDFAVYFCQQSWYDPLTFGQGTKLEIK |
| CL-34586 | 2436 | EIVLTQSPATLSLSPGERATLSCRASQSVXXHMHWYQQKPGQAPRLLIYGASTLESGVPARFSGSGSGTDFTLTISSLEPEDFAVYYCQQTWTDPXTFGQGTKLEIK |
| CL-34587 | 2437 | EIVLTQSPATLSLSPGERATLSCRASESVSTHLHWYQQKPGQAPRLLIYGASILESGIPARFSGSGSGTDFTLTISSLEPEDFAVYYCQQSWYDPLTFGQGTKLEIK |
| CL-34590 | 2438 | EIVLTQSPATLSLSPGERATLSCRASESVSTHMHWYQQKPGQAPRLLIYGASILESGVPARFSGSGSGTDFTLTISSLEPEDFAVYYCQQSWYDPLTFGQGTKLEIK |
| CL-34591 | 2439 | EIVLTQSPATLSLSPGERATLSCRASQSVGTHMHWYQQKPGQAPRLLIYGASNLESGIPARFSGSGSGTDFTLTISSLEPEDFAVYYCQQTWYDPITFGQGTKLEIK |
| CL-34592 | 2440 | EIVLTQSPATLSLSPGERATLSCRASESVSTHMHWYQQKPGQAPRLLIYGASNLESGIPARFSGSGSGTDFTLTISSLEPEDFAVYYCQQSWYDPITFGQGTKLEIK |
| CL-34593 | 2441 | EIVLTQSPATLSLSPGERATLSCRASESVSTHMHWYQQKPGQAPRLLIYGASMLESGIPARFSGSGSGTDFTLTISSLEPEDFAVYYCQQSWYDPLTFGQGTKLEIK |
| CL-34594 | 2442 | EIVLTQSPATLSLSPGERATLSCRASQSVSTHMHWYQQKPGQAPRLLIYGASILESGVPARFSGSGSGTDFTLTISSLEPEDFAVYYCQQTWYDPITFGQGTKLEIK |
| CL-34598 | 2443 | EIVLTQSPATLSLSPGERATLSCRASQSVSNHMHWYQQKPGQAPRLLIYGASNLESGVPARFSGSGSGTDFTLTISSLEPEDFAVYYCQQSWIEPYTFGQGTKLEIK |
| CL-34599 | 2444 | EIVLTQSPATLSLSPGERATLSCRASQSVSTHMHWYQQKPGQAPRLLIYGASNLESGVPARFSGSGSGTDFTLTISSLEPEDFAVYYCQQTWYDPITFGQGTKLEIK |
| CL-34600 | 2445 | EIVLTQSPATLSLSPGERATLSCRASESVNTHMHWYQQKPGQAPRLLIYGASILESGVPARFSGSGSGTDFTLTISSLEPEDFAVYYCQQSWNDPFTFGQGTKLEIK |
| CL-34601 | 2446 | EIVLTQSPATLSLSPGERATLSCRASQSVGTHMHWYQQKPGQAPRLLIYGASILESGIPARFSGSGSGTDFTLTISSLEPEDFAVYFCQQSWYDPLTFGQGTKLEIK |
| CL-34602 | 2447 | EIVLTQSPATLSLSPGERATLSCRASQSVGTHMHWYQQKPGQAPRLLIYGASILESGVPARFSGSGSGTDFTLTISSLEPEDFAVYFCQQSWYDPGTFGQGTKLEIK |

TABLE 39-continued

List of Amino Acid Sequences of Affinity Matured H4q8.3 VL Variants

| Clone | SEQ ID NO: | VL |
|---|---|---|
| CL-34604 | 2448 | EIVLTQSPATLSLSPGERATLSCRASQSVNNHMHWYQQKPGQA PRLLIYGASNLESGIPARFSGSGSGTDFTLTISSLEPEDFAVY YCQQSWYDPLTFGQGTKLEIK |
| CL-34610 | 2449 | EIVLTQSPATLSLSPGERATLSCRASQSVSTHMHWYQQKPGQA PRLLIYGASNLESGIPARFSGSGSGTDFTLTISSLEPEDFAVY YCQQTWYDPLTFGQGTKLEIK |
| CL-34612 | 2450 | EIVLTQSPATLSLSPGERATLSCRASQSVGTHMQWYQQKPGQA PRLLIYGASILESGIPARFSGSGSGTDFTLTISSLEHEDFAVY XCQQSWYDPLTFGQGTKLEIK |
| CL-34613 | 2451 | EIVLTQSPATLSLSPGERATLSCRASESVGRHMHWYQQKPGQA PRLLIYGASNLESGIPARFSGSGSGTDFTLTISSLEPEDFAVY FCQQTWYDPITFGQGTKLEIK |
| CL-34614 | 2452 | EIVLTQSPATLSLSPGERATLSCRASESVSTHMHWYQQKPGQA PRLLIYGASYLESGVPARFSGSGSGTDFTLTISSLEPEDFAVY FCQQSWYDPLTFGQGTKLEIK |
| CL-34617 | 2453 | EIVLTQSPATLSLSPGERATLSCRASESVDSSMHWYQQKPGQA PRLLIYGASILESGVPARFSGSGSGTDFTLTISSLEPEDFAVY YCQQTWYDPLTFGQGTKLEIK |
| CL-34618 | 2454 | EIVLTQSPATLSLSPGERATLSCRASESVSTHMHWYQQKPGQA PRLLIYGASILESGVPARFSGSGSGTDFTLTISSLEPEDFAVY YCQQTWYDPITFGQGTKLEIK |
| CL-40245 | 2455 | EIVLTQSPATLSLSPGERAALSCRASQSVSTHMHWYQQKPGQA PRLLIYGASNLESGIPARFSGSGSGTDFTLTISSLEPEDFAVY YCQQSWYDPLTFGQGTKLEIK |
| CL-40250 | 2456 | EIVLTQSPATLSLSPGERATLSYRASQSVGTHMHWYQQKPGQA PRLLIYGASHLESGIPARFSGSGSGTDFTLTISSLEPEDFAVY YCQQTWYDPLTFGQGTKLEIK |
| CL-40251 | 2457 | EIVLTQSPGTLSLSPGERATLSCRASQSVGTHMHWYQQKPGQA PRLLIYGASKLESGVPARFSGSGSGTDFTLTISSLEPEDFAVY YCQQSWYDPLTFGQGTKLEIK |
| CL-40253 | 2458 | EIVLTQSPATLSLSPGERATLSCRASQSVSTHMHWYQQKPGQA PRLLIYGASNLESGVPARFSGSGSGADFTLTISSLEPEDFAVY YCQQSWYDPLTFGQGTKLEIK |
| CL-40255 | 2459 | EIVLTQSPGTLSLSPGERATLSCRASESVSTHMHWYQQKPGQA PRLLIYGASNLESGVPARFSGSGSGTDFTLTISSLEPEDFAVY YCQQSWYDPLTFGQGTKLEIK |
| CL-40258 | 2460 | EIVLTQSPATLSLSPGERATLSCRASQSVGTHMHWYQQKPGQA PRLLIYGASHPESGIPARFSGSGSGTDFTLTISSLEPEDFAVY YCQQTWYDPLTFGQGTKLEIK |
| CL-40266 | 2461 | EIVLTQSPATLSLSPGERATLSCRASQSVSTHMHWYQQKPGQA PRLLIYGASNLESGVPARFSGSGSGTDFTLTISSLEPEDFAVY FCQQSWYDPMTFGQGTKLEIK |
| CL-40271 | 2462 | EIVLTQSPATLSLSPGERATLSCRASQSVGTHMHWYQQKPGQA PRLLIYGASHLESGIPARFSGSGSGTDFTLTISSLEPEDFAVY YCQQTWYDPLTFGQGTKLGSN |
| CL-40272 | 2463 | EIVLTQSPATLSLSPGERATLSCRASQSVGTHMHWYQQKPGQA PRLLIYGASKLESGVPARFSGSGSGTDFTLTISSLEPEDFAVY YCQQSWYDPLTFGQGTKLRSN |
| CL-40283 | 2464 | EIVLTQSPGTLSLSPGERATLSCRASQSVSTHMHWYQQKPGQA PRLLIYGASNLESGIPARFSGSGSGTDFTLTISSLEPEDFAVY FCQQSWYDPMTFGQGTKLEIK |
| CL-40284 | 2465 | EIVLTQSPATLSLSPGERAILSCRASQSVGTHMHWYQQKPGQA PRLLIYGASKLESGVPARFSGSGSGTDFTLTISSLEPEDFAVY YCQQSWYDPLAFGQGTKLEIK |

TABLE 39-continued

List of Amino Acid Sequences of Affinity Matured H4q8.3 VL Variants

| Clone | SEQ ID NO: | VL |
|---|---|---|
| CL-40286 | 2466 | EIVLPQSPATLSLSPGERATLSCRASESVSTHMHWYQQKPGQAPRLLIYGASNLEPGVPARFSGSGSGTDFTLTISSLEPEDFAVYFCQQSWNDPFTFGQGTKLEIK |
| CL-40287 | 2467 | EIVLTQSPGTLSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| CL-40288 | 2468 | EIVLTQSPGTLSLSPGERATLSCRASQSVSTHMHWYQQKPGQAPRLLIYGASNLESGVPARFSGSGSGTDFTLTISSLEPEDFAVYYCQQSWYDPLTFGQGTKLEIK |
| CL-40299 | 2469 | RNCVTQSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK |
| CL-40302 | 2470 | EIVLTQSPATLSLSPGERATLSCRASQSVGTHMHWYQQKPGQAPRLLIYGASKLESGVPARFSGSGSGTDFTLTISSLEPEDFAVYYCQQSWCDPLTFGQGTKLEIK |
| CL-40303 | 2471 | EIVLTQSPATLSLSPGERATLSCRASQSVSTHMHWYQQKPGQAPRLPIYGASNLESGVPARFSGSGSGTDFTLTISSLEPEDFAVYYCQQSWYDPLTFGQGTKLEIK |
| CL-40317 | 2472 | EIVLTQSPATLSLSPGERATLSCRASQSVGTHMHWYQQKPGQAPRLLIYGASKLESGVPARFSGSGSGTDFTLTISSLGPEDFAVYYCQQSWYDPLTFGQGTKLEIK |
| CL-40324 | 2473 | EIVLTQSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK |
| CL-40327 | 2474 | EIVLTQSPATLSLSPGERATLSCRASQSVSTHMHWYQQKPGQAPRLLIYGASNLESGIPARFSGSGSGTDFTLTISSLEPEDFAVYFCQQSWYDPMTFGQGTKLEIK |
| CL-40328 | 2475 | EIVLTQSPGTLSLSPGERATLSCRASESVSTHMHWYQQKPGQAPRLLIYGASKLESGVPARFSGSGSGTDFTLTISSLEPEDFAVYYCQQSWYDPLTFGQGTKLEIK |
| CL-40331 | 2476 | EIVLTQSPATLSLSPGERATLSCRASQSVSTHMHWYQQKPGQAPRLLIYGASNLESGVPARFSGSGSGTDFTLTISSLEPEDFAVYYCQQSWYDPLTFGQRTKLEIK |
| CL-40332 | 2477 | EIVLTQSPATLSLSPGERATLSCRASQSVSTHMHWYQQKPGQAPRLLIYGASNLESGIPARFSGSGSGTDFTLTISSLEPEDFAVYFCQQSWYDPMAFGQGTKLEIK |
| CL-40335 | 2478 | RNCVDKSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK |
| CL-40336 | 2479 | EIVLTQSPATLSLSPGERATLSCRASQSVGTHMHWYQQKPGQAPRLLIYGASKLESGVPARFSGSGSGTDFTLTISSLEPEDFAVYYCQQSWYDPLTFGQGTKLEIK |
| CL-40337 | 2480 | EIVLTQSPATLSLSPGERATLSCRASQSVSTHMHWYQQKPGQAPRLLIYGASNLESGVPARFSGSGSGTDFTLTISSLEPEDFAVYYCQRSWYDPLTFGQGTKLEIK |
| CL-40338 | 2481 | EIVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK |
| CL-40339 | 2482 | EIVLTQSPATLSLSPGERATLSCRASQSVSTHMHWYQQKPGQAPRLLIYGASNLESGVPARFSGSGSGTDFTLTISSLEPEDFAVYYCQQSWYDPLTFGQGTKLEIK |
| CL-40341 | 2483 | EIVLTQSPATLSLSPGERATLFCRASQSVSNHMHWYQQKPGQAPRLLIYGASILESGVPARFSGSGSGTDFTLTISSLEPEDFVVYYCQQSWYDPITFGQGTKLEIK |

TABLE 39-continued

List of Amino Acid Sequences of Affinity Matured H4q8.3 VL Variants

| Clone | SEQ ID NO: | VL |
|---|---|---|
| CL-40342 | 2484 | EIVLTQSPATLSLSPGERATLSCRASQSVSTHMHWYQQKPGQAPRLLIYGASILESGVPARFSGSGSGTDFTLTISSLEPEDFAVYFCQQTCYDPLTFGQGTKLEIK |
| CL-40350 | 2485 | EIVLTQSPATLSLSPGERATLSCRASQSVSTHMHWYQQKPGQAPRLLIYGASNLESGIPARFSGSGSGADFTLTISSLEPEDFAVYFCQQSWYDPLTFGQGTKLEIK |
| CL-40356 | 2486 | EIVLTQSPATLSLSPGERATLSCRASESVGKHMHWYQQKPGQAPRLLIYGASNLESGIPARFSGSGSGTDFTLTISSLEPEDFAVYFCQQTWYDPITFGQGTKLEIK |
| CL-40357 | 2487 | EIVLTQSPATLSLSPGERATLFCRASQSVSNHMHWYQQKPGQAPRLLIYGASILESGVPARFSGSGSGTDFTLTISSLEPEDFAVYYCQQTWYDPLTFGQGTKLEIK |
| CL-40364 | 2488 | EIVLTQSPGTLSLSPGERATLSCRASQSVSTHMHWYQQKPGQAPRLLIYGASNLESGIPARFSGSGSGTDFTLTISSLEPEDFAVYYCQQSFYDPLTFGQGTKLEIK |
| CL-40367 | 2489 | EIVLTQSPGTLSLSPGERATLSCRASQSVSTHMHWYQQKPGQAPRLLIYGASILESGVPARFSGSGSGTDFTLTISSLEPEDFAVYFCQQTWYDPLTFGQGTKLEIK |
| CL-40370 | 2490 | EIVLTQSPATLSLSPGERATLSCRASQSVSTHMHWYQQKPGQAPRLLIYGASNLESGIPARFSGSGSGTDFILTISSLEPEDFAVYYCQQSFYDPLTFGQGTKLEIK |
| CL-40373 | 2491 | EIVLTQSPGTLSLSPGERATLSCRASQSVSTHMHWYQQKPGQAPRLLIYGASNLESGIPARFSGSGSGTDFTLTISSLEPEDFAVYFCQQSWYDPLTFGQGTKLEIK |
| CL-40381 | 2492 | EIVLTQSPGTLSLSPGERATLSCRASQSVSTHMHWYQQKPGQAPRLLIYGASILESGVPARFSGSGSGTDFTLTISSLEPEDFAIYFCQQTWYDPLTFGQGTKLEIK |
| CL-40382 | 2493 | EIVLTQSPATLSLSPGERATLSCRASQSVSTHMHWYQQKPGQAPRLLIYGASILESGVPARFSGSGSGIDFTLTISSLEPEDFAVYFCQQTWYDPLTFGQGTKLEIK |
| CL-40390 | 2494 | EIVLTQSPATLSLSPGERATLSCRASGSVGKHMHWYQQKPGQAPRLLIYAASNLESGVPARFSGSGSGTDFTLTISSLEPEDFAVYYCQQSWYDPLTFGQGTKLEIK |
| CL-40394 | 2495 | EIVLTQSPGTLSLSPGERATLSCRASQSVSTHMHWYQQKPGQAPRLLIYGASILESGVPARFSGSGSGTDFTLTISSLEPEEFAVYFCQQTWYDPLTFGQGTKLEIK |
| CL-40399 | 2496 | EIVLTQSPATLSLSPGERATLSCRASQSVSKHMHWYQQKPGQAPRLLIYGASNLESGIPARFSGSGSGTDSLTISSLEPEDFAVYFCQQTWYDPITFGQGTKLEIK |
| CL-40408 | 2497 | EIVLTQSPATLSLPPGERATLSCRASQSVSTHMHWYQQKPGQAPRLLIYGASNLESGIPARFSGSGSGTDFTLTISSLEPEDFAVYYCQQSFYDPLTFGQGTKLEIK |
| CL-40414 | 2498 | EIVLTQSPATLSLSPGERATLSCRASQSVSTHMHWYQQKPGQAPRLLIYGASNLESGIPARFGGSGSGTDFTLTISSLEPEDFAVYYCQQSFYDPLTFGQGTKLEIK |
| CL-40426 | 2499 | EIVSTQSPATLSLSPGERATLSCRASQSVSTHMHWYQQKPGQAPRLLIYGASNLESGIPARFSGSGSGTDFTLTIGSLEPEDFAVYFCQQSWYDPLTFGQGTKLEIK |
| CL-40440 | 2500 | EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTNLEIK |
| CL-40441 | 2501 | EIVLTQSPATLSLSPGERATFSCRASQSVSTHMHWYQQKPGQAPRLLIYGASKLESGVPARFSGSGSGTDFTLTISSLEPEDFAVYYCQQSWYDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-40443 | 2502 | EIVLTQSPATLSLSPGERATLSCRASQSVSTHMHWYQQKPGQAPRLLIYGASNLESGVPARFSGSGSGTDFTLTISSLEPEDFAAYFCQQTWYDPLTFGQGTKLEIK |
| CL-40445 | 2503 | EIVLTQSPSTLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK |
| CL-40447 | 2504 | EIVLTQSPATLSLSPGERATLSCRASQSVNNHMHWYQQKPGQAPRLLIYGASILESGVPARFSGSGSGTDFTLTISSLEPEDFAVYFCQQSWYDPLTFGQGTKLEIX |
| CL-40453 | 2505 | EIVLTQSPATLSLSPGERATLSCRASQSVSTHMHWCQQKPGQAPRLLIYGASNLESGVPARFSGSGSGTDFTLTISSLEPEDFAVYFCQQTWYDPLTFGQGTKLEIK |
| CL-40463 | 2506 | EIVLTQSPGTLSLSPGERATLSCRASQSVNNHMHWYQQKPGQAPRLLIYGASILESGVPARFSGSGSGTDFTLTISSLEPEDFAVYFCQQSWYDPLTFGQGTKLEIK |
| CL-40466 | 2507 | EIVLTQSPATLSLSPGERATLSCRASQSVSTHMHWYQQKPGQAPRLLIYGASILESGVPARFSGSGSGTDFTLTISSLEPEDFAVYFCQQSWYDPLTFGQGTKLEIK |
| CL-40470 | 2508 | EIVLTQSPGTLSLSPGERATLSCRASQSVSTHMHWYQQKPGQAPRLLIYGASNLESGVPARFSGSGSGTDFTLTISSLEPEDFAVYFCQQSWYDPLTFGQGTKLEIK |
| CL-40472 | 2509 | EIVLTQSPATLSLSPGERATLSCRASQSVNNHMHWYQQKPGQAPRLLIYGASILESGVPARFSGSGSGTDFTLTISSLEPEDFAVYYCQQSWYDPLTFGQGTKLEIK |
| CL-40476 | 2510 | EIVLTQSPATLSLSPGERATLSCRASQSVSTHMHWYQQKPGQAPRLLIYGASKLESGVPARFSGSGSGTDFTLTISSLEPEDFAVYYCQQSWYDPLTFGQGTKLRSN |
| CL-40479 | 2511 | EIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLRSN |
| CL-40480 | 2512 | EIVLTQSPGTLSLSPGERATLSCRASQSVSTHMHWYQQEPGQAPRLLIYGASKLESGVPARFSGSGSGTDFTLTISSLEPEDFAVYYCQQSWYDPLTFGQGTKLEIK |
| CL-40484 | 2513 | EIVLTQSPGTLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK |
| CL-40485 | 2514 | RNLLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK |
| CL-40489 | 2515 | EIVLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLVIK |
| CL-40494 | 2516 | EIVLTQSPATLSLSPGERATLSCRASQSVSTHMHWYQQKPGQAPRLLIYGASNLESGVPARFSGSGSGADFTLTISSLEPEDFAVYFCQQTWYDPLTFGQGTKLEIK |
| CL-40498 | 2517 | EIVLTQSPATLSLSPGERATLSCRASQSVNNHMHWYQQKPGQAPRLLIYGASILESGVPARFSGSGSGTDFTLTISSLEPEDFAVYFCQQSRYDPLTFGQGTKLEIK |
| CL-40503 | 2518 | EIVLTQSPGTLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK |
| CL-40505 | 2519 | EIVLTQSPGTLSLSPGERATLSCRASQSVATHMHWYQQKPGQAPRLLIYGASNLESGVPARFSGSGSGTDFTLTISSLEPEDFAVYYCQQSWYDPLTFGQGTKLEIK |

TABLE 39-continued

List of Amino Acid Sequences of Affinity Matured H4q8.3 VL Variants

| Clone | SEQ ID NO: | VL |
|---|---|---|
| CL-40511 | 2520 | AIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLEIK |
| CL-40526 | 2521 | EIVLTQSPAALSLSPGERATLSCRASQSVSTHMHWYQQKPGQAPRLLIYGASNLESGVPARFSGSGSGTDFTLTISSLEPEDFAVYFCQQTWYDPLTFGQGTKLEIK |
| CL-40531 | 2522 | EIVLTQSPATLSLSPGERATLSCRASQSVNNHMHWYQQKPGQAPRLLIYGASIPESGVPARFSGSGSGTDFTLTISSLEPEDFAVYFCQQSWYDPLTFGQGTKLEIK |
| CL-41836 | 2523 | AIVLTQSPGTLSLSPGERATLSCRASQSVATHMHWYQQKPGQAPRLLIYGASNLESGVPARFSGSGSGTDFTLTISSLEPEDFAVYYCQQSWYDPLTFGQGTKLEIK |
| CL-41845 | 2524 | EIVLTQSPATLSLSPGERATLSCRASQSVNNHMHWYQQKPGQAPRLLIYGASILESGVPARFSGSGSGTDFTLTISSLEPEDFAVYFCQQSWYDPLTFGQGTKLEIK |
| CL-41849 | 2525 | EIVLTQSPATLSLSPGERATLSCRASQSVSTHMHWYQQKPGQAPRLLIYGASKLESGVPARFSGSGSGTDFTLTISSLEPEDFAVYYCQQSWYDPLTFGQGTKLEIK |
| CL-41850 | 2526 | EIVLTQSPATLSLSPGERATLSCRASQSVSTHMHWYQQKPGQAPRLLIYGASNLESGVPARFSGSGSGTDFTLTISSLEPEDFAVYYCQQSWYDPLTFGQGTKLEIK |
| CL-41852 | 2527 | EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK |
| CL-41854 | 2528 | EIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLEIK |
| CL-41855 | 2529 | EIVLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK |
| CL-41885 | 2530 | EIVLTQSPATLSLSPGERATLSCRASQSVSTHMHWYQQKPGQAPRLLIYGASILESGVPARFSGSGSGTDFTLTITSLEPEDFAVYFCXQTWYDPLTFGQGTKLEIK |
| CL-41886 | 2531 | EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLRSN |
| CL-41888 | 2532 | EIVLTQSPATLSLSPGERATLSCRASQSVSTHMHWYQQKPGQAPRLLIYGASILESGVPARFSGSGSGTDFTLTISSLEPEDFAVYYCQQTWYDPLTFGQGTKLEIK |
| CL-41920 | 2533 | EIVLTQSPGTLSLSPGERASLSCRASQSVSTHMHWYQQKPGQAPRLLIYGASNLESGIPARFSGSGSGTDFTLTISSLEPEDFAVYYCQQSFYDPLTFGRGTKLEIK |
| CL-41923 | 2534 | EIVLTQSPATLSLSPGERATLSCRASQSVSTHMHWYQQKPGQAPRLLIYGASNLESGIPARFSGSGSGTDFTLTISSLEPEDFAVYFCQQSWYDPLTFGQGTKLEIN |
| CL-41928 | 2535 | EIVLTQSPATLSLSPGERATLSCRTSESVGKHMHWYQQKPGQAPRLLIYAASNLESGVPARFSGSGSGTDFTLTISSLEPEDFAVYYCQQSWYDPLTFGQGTKLEIK |
| CL-41938 | 2536 | EIVLTQSPATLSLSPGERATLSCRASESVGKHMHWYQQKPGQAPRLLIYAASNLESGVPARFSGSGSGTDFTLTISSLEPEDFAVYYCQQSWYDPLTFGQGTKLEIK |
| CL-41940 | 2537 | EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIK |

TABLE 39-continued

List of Amino Acid Sequences of Affinity Matured H4g8.3 VL Variants

| Clone | SEQ ID NO: | VL |
|---|---|---|
| CL-41941 | 2538 | EIVLTQSPATLSLSPGERATLSCRASQSVSTHMHWYQQKPGQAPRLLIYGASILESGVPARFSGSGSGTDFTLTISSLEPEDFAVYFCQQTWYDPLTFGQGTKLEIK |
| CL-41947 | 2539 | EIVLTQSPATLSLSPGERATLSCRASQSVSTHMHWYQQKPGQAPRLLIYGASNLESGIPARFSGSGSGTDFTLTISSLEPEDFAVYYCQQSFYDPLTFGQGTKLEIQ |
| CL-41949 | 2540 | EIVLTQSPATLSLSPGERATLSCRASQSVSKHMHWYQQKPGQAPRLLIYGASNLESGIPARFSGSGSGTDFTLTISSLEPEDFAVYFCQQTWYDPITFGQGTKLEIK |
| CL-41950 | 2541 | EIVLTQSPATLSLSPGERATLSCRASQSVSTHMHWYQQKPGQAPRLLIYGASNLESGVPARFSGSGSGTDFTLTISSLEPEDFAVYYCQQTWYDPLTFGQGTKLEIK |
| CL-41951 | 2542 | EIVLTQSPATLSLSPGERATLSCRASQSVSTHMHWYQQKPGQAPRLLIYGASNLESGIPARFSGSGSGTDFTLTISSLEPEDFAVYYCQQSFYDPLTFGQGTKLEIK |
| CL-41952 | 2543 | EIVLTQSPATLSLSPGERATLSCRASQSVSTHMHWYQQKPGQAPRLLIYGASNLESGIPARFSGSGSGTDFTLTISSLEPEDFAVYFCQQSWYDPLTFGQGTKLEIK |

TABLE 40

Amino Acid Residues Found In Each Position of the Heavy Chain Variable Region During The Affinity Maturation Of Humanized Anti-Human VEGF Antibody Hbdb-4G8.3
hBDB-4G8|Heavy Chain Variable Region SEQ ID NO: Sequence

```
2544           1         2         3         4         5         6
      123456789012345678901234567890123456789012345678901234567890
      EVQLVQSGSELKKPGASVKVSCKASGYTFTNYGMYWVRQAPGQGLEWMGWINTETGKPTY
               R        S        S                          Y   N I
                        N        QK D                       L   D M
                                 DY K                       V   T K
                                 ET C                       W   P A
                                 NM V                       A   W N
                                 AG E                       Q   Y P
                                 GA L                       H   V L
                                 HI W                       G   S V
                                 KL P                       K   M W
                                 ME Y                       N   A D
                                 LP M                       M   I Y
                                 RQ N                       T   G G
                                 IF T                       P   R E
                                 Y                                L
                                 V
               7         8         9        10        11        12
      123456789012345678901234567890123456789012345678901234567890
      ADDFKGRFVFSLDTSVSTAYLQISSLKAEDTAVYYCARTNYYYRSYIFYFDYWGQGTMVT
       Y   N           T           D         H    N L
       H                                     YI   ST N
                                             GT   NK T
                                             ID   EM V
                                             S    MY A
                                             KF   LC R
                                             NL   TI F
                                             PE   WF D
                                             LV   QL
                                             WY   GD S
                                             MA   IW
                                             FG   AX
                                             RW   CV
                                             QQ   V
                                             R
```

TABLE 40-continued

Amino Acid Residues Found In Each Position of the Heavy
Chain Variable Region During The Affinity Maturation Of
Humanized Anti-Human VEGF Antibody Hbdb-4G8.3
hBDB-4G8|Heavy Chain Variable Region SEQ ID NO: Sequence

```
              123
              VSS
              SFQ
              L
```

TABLE 41

Amino Acid Residues Found In Each Position of the Light
Chain Variable Region During The Affinity Maturation Of
Humanized Anti-Human VEGF Antibody Hbdb-4G8.3
hBDB-4G8|Light Chain Variable Region SEQ ID NO: Sequence

```
2545            1         2         3         4         5         6
       123456789012345678901234567890123456789012345678901234567890
       EIVLTQSPATLSLSPGERATLSCRASESVSTHMHWYQQKPGQAPRLLIYGASNLESGVPA
                            A            NSA A              W  H  Y
                                         DRD P              V  Y
                                           C                I  M
                                         TAP                E  T
                                         RER                S  F
                                         HDY                D  V
                                         EM                    R
                                         IPL                   Q
                                         LYQ                   A
                                         QIK                   S
                                         CW                    E
                                         MF                    G
                                         Y                     C
                                         K                     D
                                         V                     P
                7         8         9         10
       1234567890123456789012345678901234567
       RFSGSGSGTDFTLTISSLEPEDFAVYFCQQSWNDPFTFGQGTKLEIK
                                   CCIN M          G
                                   GLTY G
                                   IGDA Y
                                   W GL
                                   REM  A
                                   NSSM W
                                   A HP S
                                   Y AG V
                                   K RH C
                                   Q VF P
                                   F LK
                                     F
                                     K
                                     Q
```

TABLE 42

Variable Region Sequences of hBDB-4G8.3 Affinity
Matured Clones Converted To IgG

| SEQ ID NO: | Clone | Protein Region | V Region 12345678901234567890123456789 |
|---|---|---|---|
| 2546 | CL-32416 | VH | EVQLVQSGSELKKPGASVKVSCKASGYTFTDYGMYW VRQAPGQGLEWMGWIDTETGEPTYADDFKGRFVFSL DTSVSTAYLQISSLKAEDTAVYYCARTNYYYRSYMF YFDYWGQGTMVTVSS |
| 2547 | CL-32416 | CDR-H1 | GYTFTDYGMY |
| 2548 | CL-32416 | CDR-H2 | WIDTETGEPTYADDFKG |
| 2549 | CL-32416 | CDR-H3 | TNYYYRSYMFYFDY |

TABLE 42-continued

Variable Region Sequences of hBDB-4G8.3 Affinity
Matured Clones Converted To IgG

| SEQ ID NO: | Clone | Protein Region | V Region<br>123456789012345678901234567890 |
|---|---|---|---|
| 2550 | CL-32416 | VL | EIVLTQSPATLSLSPGERATLSCRASESVSTHMHWY<br>QQKPGQAPRLLIYGASNLESGVPARFSGSGSGTDFT<br>LTISSLEPEDFAVYFCQQSWNDPFTFGQGTKLEIK |
| 2551 | CL-32416 | CDR-L1 | RASESVSTHMH |
| 2552 | CL-32416 | CDR-L2 | GASNLES |
| 2553 | CL-32416 | CDR-L3 | QQSWNDPFT |
| 2554 | CL-34449 | VH | EVQLVQSGSELKKPGASVKVSCKASGYTFTDYGMYW<br>VRQAPGQGLEWMGWIDTETGEPTYADDFKGRFVFSL<br>DTSVSTAYLQISSLKAEDTAVYYCARTNYYYRSYMF<br>YFDYWGQGTMVTVSS |
| 2555 | CL-34449 | CDR-H1 | GYTFTDYGMY |
| 2556 | CL-34449 | CDR-H2 | WIDTETGEPTYADDFKG |
| 2557 | CL-34449 | CDR-H3 | TNYYYRSYMFYFDY |
| 2558 | CL-34449 | VL | EIVLTQSPATLSLSPGERATLSCRASQSVGTHMHWY<br>QQKPGQAPRLLIYGASHLESGIPARFSGSGSGTDFT<br>LTISSLEPEDFAVYYCQQTWYDPLTFGQGTKLEIK |
| 2559 | CL-34449 | CDR-L1 | RASQSVGTHMH |
| 2560 | CL-34449 | CDR-L2 | GASHLES |
| 2561 | CL-34449 | CDR-L3 | QQTWYDPLT |
| 2562 | CL-34455 | VH | EVQLVQSGSELKKPGASVKVSCKASGYTFTNYGMYW<br>VRQAPGQGLEWMGWIDTETGEPTYAQGFTGRFVFSL<br>DTSVSTAYLQISSLKAEDTAVYYCARTNYYYPSYMF<br>YFDYWGQGTMVTVSS |
| 2563 | CL-34455 | CDR-H1 | GYTFTNYGMY |
| 2564 | CL-34455 | CDR-H2 | WIDTETGEPTYAQGFTG |
| 2565 | CL-34455 | CDR-H3 | TNYYYPSYMFYFDY |
| 2566 | CL-34455 | VL | EIVLTQSPATLSLSPGERATLSCRASQSVGTHMHWY<br>QQKPGQAPRLLIYGASKLESGVPARFSGSGSGTDFT<br>LTISSLEPEDFAVYYCQQSWYDPLTFGQGTKLEIK |
| 2567 | CL-34455 | CDR-L1 | RASQSVGTHMH |
| 2568 | CL-34455 | CDR-L2 | GASKLES |
| 2569 | CL-34455 | CDR-L3 | QQSWYDPLT |
| 2570 | CL-34463 | VH | EVQLVQSGSELKKPGASVKVSCKASGYTFTDYGMYW<br>VRQAPGQGLEWMGWIDTETGNPTYADDFKGRFVFSL<br>DTSVSTAYLQISSLKAEDTAVYYCARTNYYYPSYMF<br>YFDYWGQGTMVTVSS |
| 2571 | CL-34463 | CDR-H1 | GYTFTDYGMY |
| 2572 | CL-34463 | CDR-H2 | WIDTETGNPTYADDFKG |
| 2573 | CL-34463 | CDR-H3 | TNYYYPSYMFYFDY |
| 2574 | CL-34463 | VL | EIVLTQSPATLSLSPGERATLSCRASQSVSKHMHWY<br>QQKPGQAPRLLIYGASNLESGIPARFSGSGSGTDFT<br>LTISSLEPEDFAVYFCQQTWYDPITFGQGTKLEIK |
| 2575 | CL-34463 | CDR-L1 | RASQSVSKHMH |
| 2576 | CL-34463 | CDR-L2 | GASNLES |
| 2577 | CL-34463 | CDR-L3 | QQTWYDPIT |

TABLE 42-continued

Variable Region Sequences of hBDB-4G8.3 Affinity
Matured Clones Converted To IgG

| SEQ ID NO: | Clone | Protein Region | V Region 12345678901234567890123456789 0 |
|---|---|---|---|
| 2578 | CL-34469 | VH | EVQLVQSGSELKKPGASVKVSCKASGYTFTNYGMYW VRQAPGQGLEWMGWIDTETGEPTYADDFKGRFVFSL DTSVSTAYLQISSLKAEDTAVYYCARTNYYYRSYMF YFDYWGQGTMVTVSS |
| 2579 | CL-34469 | CDR-H1 | GYTFTNYGMY |
| 2580 | CL-34469 | CDR-H2 | WIDTETGEPTYADDFKG |
| 2581 | CL-34469 | CDR-H3 | TNYYYRSYMFYFDY |
| 2582 | CL-34469 | VL | EIVLTQSPATLSLSPGERATLSCRASQSVSTHMHWY QQKPGQAPRLLIYGASNLESGVPARFSGSGSGTDFT LTISSLEPEDFAVYYCQQSWYDPLTFGQGTKLEIK |
| 2583 | CL-34469 | CDR-L1 | RASQSVSTHMH |
| 2584 | CL-34469 | CDR-L2 | GASNLES |
| 2585 | CL-34469 | CDR-L3 | QQSWYDPLT |
| 2586 | CL-34475 | VH | EVQLVQSGSELKKPGASVKVSCKASGYTFTDYGMYW VRQAPGQGLEWMGWIDTETGEPTYADDFKGRFVFSL DTSVSTAYLQISSLKAEDTAVYYCARTNYYYSSYMF YFDYWGQGTMVTVSS |
| 2587 | CL-34475 | CDR-H1 | GYTFTDYGMY |
| 2588 | CL-34475 | CDR-H2 | WIDTETGEPTYADDFKG |
| 2589 | CL-34475 | CDR-H3 | TNYYYSSYMFYFDY |
| 2590 | CL-34475 | VL | EIVLTQSPATLSLSPGERATLSCRASQSVSTHMHWY QQKPGQAPRLLIYGASNLESGIPARFSGSGSGTDFT LTISSLEPEDFAVYYCQQSWYDPLTFGQGTKLEIK |
| 2591 | CL-34475 | CDR-L1 | RASQSVSTHMH |
| 2592 | CL-34475 | CDR-L2 | GASNLES |
| 2593 | CL-34475 | CDR-L3 | QQSWYDPLT |
| 2594 | CL-34483 | VH | EVQLVQSGSELKKPGASVKVSCKASGYTFPNYGMYW VRQAPGQGLEWMGWIDTETGEPTYADDFKGRFVFSL DTSVSTAYLQISSLKAEDTAVYYCARTNYYYRSYMF YFDYWGQGTMVTVSS |
| 2595 | CL-34483 | CDR-H1 | GYTFPNYGMY |
| 2596 | CL-34483 | CDR-H2 | WIDTETGEPTYADDFKG |
| 2597 | CL-34483 | CDR-H3 | TNYYYRSYMFYFDY |
| 2598 | CL-34483 | VL | EIVLTQSPATLSLSPGERATLSCRASQSVATHMHWY QQKPGQAPRLLIYGASNLESGVPARFSGSGSGTDFT LTISSLEPEDFAVYYCQQSWYDPLTFGQGTKLEIK |
| 2599 | CL-34483 | CDR-L1 | RASQSVATHMH |
| 2600 | CL-34483 | CDR-L2 | GASNLES |
| 2601 | CL-34483 | CDR-L3 | QQSWYDPLT |
| 2602 | CL-34489 | VH | EVQLVQSGSELKKPGASVKVSCKASGYTFSNYGMYW VRQAPGQGLEWMGWIDTETGEPTYADDFKGRFVFSL DTSVSTAYLQISSLKAEDTAVYYCARTNYYYSSYMF YFDYWGQGTMVTVSS |
| 2603 | CL-34489 | CDR-H1 | GYTFSNYGMY |
| 2604 | CL-34489 | CDR-H2 | WIDTETGEPTYADDFKG |
| 2605 | CL-34489 | CDR-H3 | TNYYYSSYMFYFDY |

TABLE 42-continued

Variable Region Sequences of hBDB-4G8.3 Affinity Matured Clones Converted To IgG

| SEQ ID NO: | Clone | Protein Region | V Region 12345678901234567890123456789 0 |
|---|---|---|---|
| 2606 | CL-34489 | VL | EIVLTQSPATLSLSPGERATLSCRASQSVSTHMHWYQQKPGQAPRLLIYGASNLESGIPARFSGSGSGTDFTLTISSLEPEDFAVYFCQQSWYDPLTFGQGTKLEIK |
| 2607 | CL-34489 | CDR-L1 | RASQSVSTHMH |
| 2608 | CL-34489 | CDR-L2 | GASNLES |
| 2609 | CL-34489 | CDR-L3 | QQSWYDPLT |
| 2610 | CL-34501 | VH | EVQLVQSGSELKKPGASVKVSCKASGYTFSDYGMYWVRQAPGQGLEWMGWIDTETGDPTYADDFKGRFVFSLDTSVSTAYLQISSLKAEDTAVYYCARTNYYYPSYMFYFDYWGQGTMVTVSS |
| 2611 | CL-34501 | CDR-H1 | GYTFSDYGMY |
| 2612 | CL-34501 | CDR-H2 | WIDTETGDPTYADDFKG |
| 2613 | CL-34501 | CDR-H3 | TNYYYPSYMFYFDY |
| 2614 | CL-34501 | VL | EIVLTQSPATLSLSPGERATLSCRASQSVSTHMHWYQQKPGQAPRLLIYGASILESGVPARFSGSGSGTDFTLTISSLEPEDFAVYFCQQTWYDPLTFGQGTKLEIK |
| 2615 | CL-34501 | CDR-L1 | RASQSVSTHMH |
| 2616 | CL-34501 | CDR-L2 | GASILES |
| 2617 | CL-34501 | CDR-L3 | QQTWYDPLT |
| 2618 | CL-34513 | VH | EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYRGYMFYFDYWGQGTMVTVSS |
| 2619 | CL-34513 | CDR-H1 | GYTFTDYGMY |
| 2620 | CL-34513 | CDR-H2 | WIDTETGEPTYADDFKG |
| 2621 | CL-34513 | CDR-H3 | TNYYYRGYMFYFDY |
| 2622 | CL-34513 | VL | EIVLTQSPATLSLSPGERATLSCRASQSVNNHMHWYQQKPGQAPRLLIYGASILESGVPARFSGSGSGTDFTLTISSLEPEDFAVYFCQQSWYDPLTFGQGTKLEIK |
| 2623 | CL-34513 | CDR-L1 | RASQSVNNHMH |
| 2624 | CL-34513 | CDR-L2 | GASILES |
| 2625 | CL-34513 | CDR-L3 | QQSWYDPLT |
| 2626 | CL-34518 | VH | EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYKSYMFYFDYWGQGTMVTVSS |
| 2627 | CL-34518 | CDR-H1 | GYTFTNYGMY |
| 2628 | CL-34518 | CDR-H2 | WIDTETGEPTYADDFKG |
| 2629 | CL-34518 | CDR-H3 | TNYYYKSYMFYFDY |
| 2630 | CL-34518 | VL | EIVLTQSPATLSLSPGERATLSCRASQSVSTHMHWYQQKPGQAPRLLIYGASKLESGVPARFSGSGSGTDFTLTISSLEPEDFAVYYCQQSWYDPLTFGQGTKLEIK |
| 2631 | CL-34518 | CDR-L1 | RASQSVSTHMH |
| 2632 | CL-34518 | CDR-L2 | GASKLES |
| 2633 | CL-34518 | CDR-L3 | QQSWYDPLT |

TABLE 42-continued

Variable Region Sequences of hBDB-4G8.3 Affinity
Matured Clones Converted To IgG

| SEQ ID NO: | Clone | Protein Region | V Region<br>12345678901234567890123456789 0 |
|---|---|---|---|
| 2634 | CL-34522 | VH | EVQLVQSGSELKKPGASVKVSCKASGYTFENYGMYW VRQAPGQGLEWMGWIDTETGEPTYADDFKGRFVFSL DTSVSTAYLQISSLKAEDTAVYYCARTNYYYSSYMF YFDYWGQGTMVTVSS |
| 2635 | CL-34522 | CDR-H1 | GYTFENYGMY |
| 2636 | CL-34522 | CDR-H2 | WIDTETGEPTYADDFKG |
| 2637 | CL-34522 | CDR-H3 | TNYYYSSYMFYFDY |
| 2638 | CL-34522 | VL | EIVLTQSPATLSLSPGERATLSCRASQSVGTHMHWY QQKPGQAPRLLIYGASKLESGVPARFSGSGSGTDFT LTISSLEPEDFAVYYCQQSWYDPLTFGQGTKLEIK |
| 2639 | CL-34522 | CDR-L1 | RASQSVGTHMH |
| 2640 | CL-34522 | CDR-L2 | GASKLES |
| 2641 | CL-34522 | CDR-L3 | QQSWYDPLT |
| 2642 | CL-34537 | VH | EVQLVQSGSELKKPGASVKVSCKASGYTFSDYGMYW VRQAPGQGLEWMGWIDTETGDPTYADDFKGRFVFSL DTSVSTAYLQISSLKAEDTAVYYCARANYYYRSYMF YFDYWGQGTMVTVSS |
| 2643 | CL-34537 | CDR-H1 | GYTFSDYGMY |
| 2644 | CL-34537 | CDR-H2 | WIDTETGDPTYADDFKG |
| 2645 | CL-34537 | CDR-H3 | ANYYYRSYMFYFDY |
| 2646 | CL-34537 | VL | EIVLTQSPATLSLSPGERATLSCRASQSVSTHMHWY QQKPGQAPRLLIYGASNLESGIPARFSGSGSGTDFT LTISSLEPEDFAVYFCQQSWYDPMTFGQGTKLEIK |
| 2647 | CL-34537 | CDR-L1 | RASQSVSTHMH |
| 2648 | CL-34537 | CDR-L2 | GASNLES |
| 2649 | CL-34537 | CDR-L3 | QQSWYDPMT |
| 2650 | CL-34538 | VH | EVQLVQSGSELKKPGASVKVSCKASGYTFTDYGMYW VRQAPGQGLEWMGWIDTETGEPTYADDFKGRFVFSL DTSVSTAYLQISSLKAEDTAVYYCARTNYYYPSYMF YFDYWGQGTMVTVSS |
| 2651 | CL-34538 | CDR-H1 | GYTFTDYGMY |
| 2652 | CL-34538 | CDR-H2 | WIDTETGEPTYADDFKG |
| 2653 | CL-34538 | CDR-H3 | TNYYYPSYMFYFDY |
| 2654 | CL-34538 | VL | EIVLTQSPATLSLSPGERATLSCRASQSVSTHMHWY QQKPGQAPRLLIYGASNLESGVPARFSGSGSGTDFT LTISSLEPEDFAVYFCQQTWYDPLTFGQGTKLEIK |
| 2655 | CL-34538 | CDR-L1 | RASQSVSTHMH |
| 2656 | CL-34538 | CDR-L2 | GASNLES |
| 2657 | CL-34538 | CDR-L3 | QQTWYDPLT |
| 2658 | CL-34540 | VH | EVQLVQSGSELKKPGASVKVSCKASGYTFTDYGMYW VRQAPGQGLEWMGWIDTETGQPTYADDFKGRFVFSL DTSVSTAYLQISSLKAEDTAVYYCARTNYYYRSYMF YFDYWGQGTMVTVSS |
| 2659 | CL-34540 | CDR-H1 | GYTFTDYGMY |
| 2660 | CL-34540 | CDR-H2 | WIDTETGQPTYADDFKG |
| 2661 | CL-34540 | CDR-H3 | TNYYYRSYMFYFDY |

TABLE 42-continued

Variable Region Sequences of hBDB-4G8.3 Affinity Matured Clones Converted To IgG

| SEQ ID NO: | Clone | Protein Region | V Region 123456789012345678901234567890 |
|---|---|---|---|
| 2662 | CL-34540 | VL | EIVLTQSPATLSLSPGERATLSCRASESVGKHMHWYQQKPGQAPRLLIYAASNLESGVPARFSGSGSGTDFTLTISSLEPEDFAVYYCQQSWYDPLTFGQGTKLEIK |
| 2663 | CL-34540 | CDR-L1 | RASESVGKHMH |
| 2664 | CL-34540 | CDR-L2 | AASNLES |
| 2665 | CL-34540 | CDR-L3 | QQSWYDPLT |
| 2666 | CL-34565 | VH | EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSS |
| 2667 | CL-34565 | CDR-H1 | GYTFTDYGMY |
| 2668 | CL-34565 | CDR-H2 | WIDTETGDPTYADDFKG |
| 2669 | CL-34565 | CDR-H3 | TNYYYRNYMFYFDY |
| 2670 | CL-34565 | VL | EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIK |
| 2671 | CL-34565 | CDR-L1 | RASQSVSNHMH |
| 2672 | CL-34565 | CDR-L2 | GASILES |
| 2673 | CL-34565 | CDR-L3 | QQSWYDPIT |
| 2674 | CL-34570 | VH | EVQLVQSGSELKKPGASVKVSCKASGYTFDDYGMYWVRQAPGQGLEWMGWIDTETGTPTYADDFKGRFVFSLDTSVSTAYLQISSLKAEDTAVYYCARTNYYYSSYMFYFDYWGQGTMVTVSS |
| 2675 | CL-34570 | CDR-H1 | GYTFDDYGMY |
| 2676 | CL-34570 | CDR-H2 | WIDTETGTPTYADDFKG |
| 2677 | CL-34570 | CDR-H3 | TNYYYSSYMFYFDY |
| 2678 | CL-34570 | VL | EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK |
| 2679 | CL-34570 | CDR-L1 | RASQSVSTHMH |
| 2680 | CL-34570 | CDR-L2 | GASNLES |
| 2681 | CL-34570 | CDR-L3 | QQSWYDPLT |
| 2682 | CL-34603 | VH | EVQLVQSGSELKKPGASVKVSCKASGYTFTDYGMYWVRQAPGQGLEWMGWIDTETGEPTYAQGFTGRFVFSLDTSVSTAYLQISSLKAEDTAVYYCARTNYYYRSYMFYFDYWGQGTMVTVSS |
| 2683 | CL-34603 | CDR-H1 | GYTFTDYGMY |
| 2684 | CL-34603 | CDR-H2 | WIDTETGEPTYAQGFTG |
| 2685 | CL-34603 | CDR-H3 | TNYYYRSYMFYFDY |
| 2686 | CL-34603 | VL | EIVLTQSPATLSLSPGERATLSCRASQSVSTHMHWYQQKPGQAPRLLIYGASNLESGVPARFSGSGSGTDFTLTISSLEPEDFAVYYCQQTWYDPLTFGQGTKLEIK |
| 2687 | CL-34603 | CDR-L1 | RASQSVSTHMH |
| 2688 | CL-34603 | CDR-L2 | GASNLES |
| 2689 | CL-34603 | CDR-L3 | QQTWYDPLT |

TABLE 42-continued

Variable Region Sequences of hBDB-4G8.3 Affinity Matured Clones Converted To IgG

| SEQ ID NO: | Clone | Protein Region | V Region 123456789012345678901234567890 |
|---|---|---|---|
| 2690 | CL-34605 | VH | EVQLVQSGSELKKPGASVKVSCKASGYTFTHYGMYW VRQAPGQGLEWMGWIDTETGEPTYADDFKGRFVFSL DTSVSTAYLQISSLKAEDTAVYYCARTNYYYRSYMF YFDYWGQGTMVTVSS |
| 2691 | CL-34605 | CDR-H1 | GYTFTHYGMY |
| 2692 | CL-34605 | CDR-H2 | WIDTETGEPTYADDFKG |
| 2693 | CL-34605 | CDR-H3 | TNYYYRSYMFYFDY |
| 2694 | CL-34605 | VL | EIVLTQSPATLSLSPGERATLSCRASQSVSTHMHWY QQKPGQAPRLLIYGASNLESGIPARFSGSGSGTDFT LTISSLEPEDFAVYYCQQSFYDPLTFGQGTKLEIK |
| 2695 | CL-34605 | CDR-L1 | RASQSVSTHMH |
| 2696 | CL-34605 | CDR-L2 | GASNLES |
| 2697 | CL-34605 | CDR-L3 | QQSFYDPLT |
| 2698 | CL-34633 | VH | EVQLVQSGSELKKPGASVKVSCKASGYTFSDYGMYW VRQAPGQGLEWMGWIDTETGEPTYADDFKGRFVFSL DTSVSTAYLQISSLKAEDTAVYYCARTNYYYRSYMF YFDYWGQGTMVTVSS |
| 2699 | CL-34633 | CDR-H1 | GYTFSDYGMY |
| 2700 | CL-34633 | CDR-H2 | WIDTETGEPTYADDFKG |
| 2701 | CL-34633 | CDR-H3 | TNYYYRSYMFYFDY |
| 2702 | CL-34633 | VL | EIVLTQSPATLSLSPGERATLSCRASQSVSTHMHWY QQKPGQAPRLLIYGASNLESGVPARFSGSGSGTDFT LTISSLEPEDFAVYFCQQSWYDPLTFGQGTKLEIK |
| 2703 | CL-34633 | CDR-L1 | RASQSVSTHMH |
| 2704 | CL-34633 | CDR-L2 | GASNLES |
| 2705 | CL-34633 | CDR-L3 | QQSWYDPLT |

TABLE 43

Summary of Protein Expression and Purification Affinity Matured Humanized Anti-Human VEGF-A Antibodies

| Name | Yield (mg/L)[1] | SEC (% monomer)[2] |
|---|---|---|
| CL-32416-IgG | 28.5 | 100.0 |
| CL-34449-IgG | 16.1 | 100.0 |
| CL-34455-IgG | 34.1 | 100.0 |
| CL-34469-IgG | 21.3 | 100.0 |
| CL-34475-IgG | 33.6 | 100.0 |
| CL-34522-IgG | 18.4 | 100.0 |
| CL-34538-IgG | 40.8 | 100.0 |
| CL-34540-IgG | 80.0 | 100.0 |
| CL-34565-IgG | 133.6 | 100.0 |
| CL-34570-IgG | 28.3 | 100.0 |
| CL-34633-IgG | 49.9 | 100.0 |

[1]Yield is determined by the total amount of purified protein in mg divided by the total cell culture volume in liters.
[2]SEC % monomer is determined using HPLC size exclusion chromatography.

TABLE 44

Biacore Binding of Affinity Matured Humanized Anti-VEGF Antibodies

| Antibody | $k_{on}$ (M-1 s-1) | $k_{off}$ (M-1) | $K_D$ (M) |
|---|---|---|---|
| CL-28815-IgG (EI version of parent mAb) | 9.2E+06 | 1.1E−04 | 1.2E−11 |
| CL-32416-IgG | 2.0E+07 | 1.1E−05 | 5.4E−13 |
| CL-34449-IgG | 1.1E+07 | 9.1E−06 | 8.5E−13 |
| CL-34455-IgG | 2.2E+07 | 1.0E−05 | 4.6E−13 |
| CL-34469-IgG | 1.5E+07 | 9.5E−06 | 6.2E−13 |
| CL-34475-IgG | 2.7E+07 | 1.4E−05 | 5.2E−13 |
| CL-34522-IgG | 2.0E+07 | 1.0E−05 | 5.3E−13 |
| CL-34538-IgG | 3.3E+07 | 8.1E−06 | 2.4E−13 |
| CL-34540-IgG | 8.4E+06 | 7.1E−06 | 8.5E−13 |
| CL-34565-IgG | 2.0E+07 | 7.8E−06 | 4.0E−13 |
| CL-34570-IgG | 1.9E+07 | 5.5E−06 | 2.9E−13 |
| CL-34633-IgG | 1.7E+07 | 4.1E−06 | 2.4E−13 |

Affinity matured humanized anti-VEGF antibodies were characterized for $hVEGF_{165}$ binding and potency. Binding affinity of these molecules to $hVEGF_{165}$ was determined by Biacore analysis (Example 1.1). Potency was evaluated in both cell-based and ELISA formats. The ability to block binding of $hVEGF_{165}$ to hVEGFR2 was evaluated in a competition ELISA (Example 1.4) Inhibition of $hVEGF_{165}$- induced cell proliferation was assessed using HMVEC-d cells (Example 1.10). The data is summarized in Table 45 below.

TABLE 45

Summary of Characterization of Affinity Matured Humanized Anti-Human VEGF-A Antibodies

| Affinity Matured Humanized IgG | VEGFR2 Competition | hVEGF₁₆₅ IC50 (nM) Potency HMVEC-d | Potency VEGFR2-3T3 |
|---|---|---|---|
| CL-32416-IgG | <0.1 | 0.117 | NT |
| CL-34449-IgG | <0.1 | 0.077 | NT |
| CL-34455-IgG | <0.1 | 0.105 | NT |
| CL-34469-IgG | <0.1 | 0.094 | NT |
| CL-34475-IgG | <0.1 | 0.106 | NT |
| CL-34522-IgG | <0.1 | 0.116 | NT |
| CL-34540-IgG | <0.1 | 0.139 | NT |
| CL-34633-IgG | <0.1 | 0.138 | NT |
| CL-34538-IgG | <0.1 | 0.127 | NT |
| CL-34570-IgG | <0.1 | 0.11 | NT |
| CL-34565-IgG | <0.1 | 0.126 | NT |

Example 8: Affinity Maturation of Anti-Human PDGF-BB Antibody hBDI-9E8

The PDGF-β antibody hBDI-9E8.4 was obtained from rat hybridomas generated at Aldevron and was humanized at AbbVie Bioresearch Center (100 Research Drive, Worcester, Mass. 01605). The human germlines for this clone are VH2-70 and IGKV3-20. To improve the affinity of hBDI-9E8.4, hypermutated CDR residues were identified from other human antibody sequences in the IgBLAST database that also shared high identity to germlines VHVH2-70 and IGKV3-20. The corresponding h9E8.4 CDR residues were then subjected to limited mutagenesis by PCR with primers having low degeneracy at these positions to create three antibody libraries in the scFv format suitable for surface display. To improve the affinity of hBDI-9E8.4 to PDGFβ we generated three antibody libraries in scFv format suitable for surface display. In the first library, residues 30, 32, 34, 35, and 35b in the VH CDR1 and residues 50, 52, 54, 56, 57, 58, 60, 61 and 65 (Kabat numbering) in the VH CDR2 were subjected to limited mutagenesis by primers. In the second library residues 95-100a, 100c and 102 (Kabat numbering) in the VH CDR3 were subjected to limited mutagenesis by primers. In the third library residues 24, 25, 27b, and 29-32 in the VL CDR1, residues 47, 50, 51, 53, 55, and 56 in the VL CDR2 and residues 90, 93-95a, 96 and 97 (Kabat numbering) in the VL CDR3 were subjected to limited mutagenesis by primers.

These hBDI-9E8.4 libraries were displayed to be selected against a low concentration of biotinylated PDGFβ by magnetic then fluorescence activated cell sorting. Selections for improved on-rate, off-rate, or both were carried out and antibody protein sequences of affinity-modulated hBDI-9E8.4 clones.

Table 46 provides a list of amino acid sequences of VH regions of affinity matured humanized PDGF antibodies derived from hBDI-9E8.4. Amino acid residues of individual CDRs of each VH sequence are indicated in bold.

TABLE 46

List of amino Acid Sequences Of Affinity Matured hBDI-9E8.4 VH Variants

| Clone | SEQ ID NO: | VH |
|---|---|---|
| CL-22556 | 2706 | EVTLRESGPALVKPTQTLTLTCTFSGFSLSTYGVGVGWIRQPPGKALEWLANIWWVDEIFYSTSLKTRLTISKDTSKNQVVLTMTNMDPVDTATYYCARIESIGTTYSFDYWGQGTMVTVSS |
| CL-22557 | 2707 | EVTLRESGPALVKPTQTLTLTCTFSGFSLWTSGMGVVWIRQPPGKALEWLALIDWADVKSYNPSLKNRLTISEDTSKNQVVLTMTNMDPVDTATYYCARIESIGTTYSFDYWGQGTMVTVSS |
| CL-22558 | 2708 | EVTLRESGPALVKPTQTLTLTCTFSGFSLSTYGVSVGWIRQPPGKALEWLALIDWYDDMYYSTSLKTRLTISKDTSKNQVVLTMTNMDPVDTATYYCARIESIGTTYSFDYWGQGTMVTVSS |
| CL-22559 | 2709 | EVTLRESGPALVKPTQTLTLTCTFSGFSLSTSGVRVVWIRQPPGKALEWLANIWWDDYLDYSTSLKTRLTISKDTSKNQVVLTMTNMDPVDTATYYCARIESIGTTYSFDYWGQGTMVTVSS |
| CL-22560 | 2710 | EVTLRESGPALVKPTQTLTLTCTFSGFSLSTYGMSVGWIRQPPGKALEWLALIDWADDTYYNPSLNNRLTISKDTSKNQVVLTMTNMDPVDTATYYCARIESIGTTYSFDYWGQGTMVTVSS |
| CL-22561 | 2711 | EVTLRESGPALVKPTQTLTLTCTFSGFSLATYGMSVAWIRQPPGKALEWLALIDWYDDEYYSTSLKTRLTISKDTSKNQVVLTMTNMDPVDTATYYCARIESIGTTYSFDYWGQGTMVTVSS |
| CL-22562 | 2712 | EVTLRESGPALVKPTQTLTLTCTFSGFSLXTYGVGVGWIRQPPGKALEWLANIWWVDDKYYSTSLKTRLTISKDTSKNQVVLTMTNMDPVDTATYYCARIESIGTTYSFDYWGQGTMVTVSS |
| CL-22563 | 2713 | EVTLRESGPALVKPTQTLTLTCTFSGFSLSTSGVGVGWIRQPPGKALEWLALIDWADDKYYNPSLKTRLTISKDTSKNQVVLTMTNMDPVDTATYYCARIESIGTTYSFDYWGQGTMVTVSS |
| CL-22564 | 2714 | EVTLRESGPALVKPTQTLTLTCTFSGFSLCTSGVRVRWIRQPPGKALEWLALIDWDDDKYYNPSLKNRLTISKDTSKNQVVLTMTNMDPVDTATYYCARIESIGTTYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-22565 | 2715 | EVTLRESGPALVKPTQTLTLTCTFSGFSLSTSGVGVGWIRQPPGK<br>ALEWLANIWWDDNXYYSTSLKTRLTISKDTSKNQVVLTMTNMDPV<br>DTATYYCARIESIGTTYSFDYWGQGTMVTVSS |
| CL-22567 | 2716 | EVTLRESGPALVKPTQTLTLTCTFSGFSLATSGVSVGWIRQPPGK<br>ALEWLALIDWEDDKGYNPSLKNRLTISKDTSKNQVVLTMTNMDPV<br>DTATYYCARIESIGTTYSFDYWGQGTMVTVSS |
| CL-22569 | 2717 | EVTLRESGPALVKPTQTLTLTCTFSGFSLSTYGMRVGWIRQPPGK<br>ALEWLALIDWDDHKYYSTSLKTRLTISKDTSKNQVVLTMTNMDPV<br>DTATYYCARIESIGTTYSFDYWGQGTMVTVSS |
| CL-22570 | 2718 | EVTLRESGPALVKPTQTLTLTCTFSGFSLCTSGVGVGWIRQPPGK<br>ALEWLALIDWDDDNYYNPSLKNRLTISKDTSKNQVVLTMTNMDPV<br>DTATYYCARIESIGTTYSFDYWGQGTMVTVSS |
| CL-22571 | 2719 | EVTLRESGPALVKPTQTLTLTCTFSGFSLFTYGMGVGWIRQPPGK<br>ALEWLALIDWVDDKFYSTSLKTRLTISKDTSKNQVVLTMTNMDPV<br>DTATYYCARIESIGTTYSFDYWGQGTMVTVSS |
| CL-22572 | 2720 | EVTLRESGPALVKPTQTLTLTCTFSGFSLCTSGVGVGWIRQPPGK<br>ALEWLANIWWDDDRYYSTSLKTRLTISKDTSKNQVVLTMTNMDPV<br>DTATYYCARIESIGTTYSFDYWGQGTMVTVSS |
| CL-22573 | 2721 | EVTLRESGPALVKPTQTLTLTCTFSGFSLCTSGMSVGWIRQPPGK<br>ALEWLALICWDDDRYYSTSLKTRLTISKDTSKNQVVLTMTNMDPV<br>DTATYYCARIESIGTTYSFDYWGQGTMVTVSS |
| CL-22575 | 2722 | EVTLRESGPALVKPTQTLTLTCTFSGFSLSTSGMRVGWIRQPPGK<br>ALEWLALIDWGDDMSYSTSLKTRLTISKDTSKNQVVLTMTNMDPV<br>DTATYYCARIESIGTTYSFDYWGQGTMVTVSS |
| CL-22576 | 2723 | EVTLRESGPALVKPTQTLTLTCTFSGFSLSTSGMGVGWIRQPPGK<br>ALEWLALIDWEDDKYYSTSLKTRLTISKDTSKNQVVLTMTNMDPV<br>DTATYYCARIESIGTTYSFDYWGQGTMVTVSS |
| CL-22578 | 2724 | EVTLRESGPALVKPTQTLTLTCTFSGFSLLTYGVGVCWIRQPPGK<br>ALEGWLNIWWADGKCYSTSLKTRLTISKDTSKNQVVLTMTNMDPV<br>DTATYYCARIESIGTTYSFDYWGQGTMVTVSS |
| CL-22581 | 2725 | EVTLRESGPALVKPTQTLTLTCTFSGFSLSTSGVRVSWIRQPPGK<br>ALEWLALIDWDDEECYSTSLKTRLTISKDTSKNQVVLTMTNMDPV<br>DTATYYCARIESIGTTYSFDYWGQGTMVTVSS |
| CL-22582 | 2726 | EVTLRESGPALVKPTQTLTLTCTFSGFSLSTSGMSVSWIRQPPGK<br>ALEWLALIDWVDDMGYSTSLKTRLTISKDTSKNQVVLTMTNMDPV<br>DTATYYCARIESIGTTYSFDYWGQGTMVTVSS |
| CL-22583 | 2727 | EVTLRESGPALVKPTQTLTLTCTFSGFSLXTYGMGVGWIRQPPGK<br>ALEWLALIDWADYRSYNPSLKNRLTISKDTSKNQVVLTMTNMDPV<br>DTATYYCARIESIGTTYSFDYWGQGTMVTVSS |
| CL-22584 | 2728 | EVTLRESGPALVKPTQTLTLTCTFSGFSLATYGVGVGWIRQPPGK<br>ALEWLALIDWEDAVNYSTSLKTRLTISKDTSKNQVVLTMTNMDPV<br>DTATYYCARIESIGTTYSFDYWGQGTMVTVSS |
| CL-22585 | 2729 | EVTLRESGPALVKPTQTLTLTCTFSGFSLCTYGMGVCWIRQPPGK<br>ALEWLALIGWDDENYYNPSLKNRLTISKDTSKNQVVLTMTNMDPV<br>DTATYYCARIESIGTTYSFDYWGQGTMVTVSS |
| CL-22586 | 2730 | EVTLRESGPALVKPTQTLTLTCTFSGFSLTTYGVRVGWIRQPPGK<br>ALEWLALIDWDDDKYYSTSLKTRLTISKDTSKNQVVLTMTNMDPV<br>DTATYYCARIESIGTTYSFDYWGQGTMVTVSS |
| CL-22587 | 2731 | EVTLRESGPALVKPTQTLTLTCTFSGFSLSTYGMSVCWIRQPPGK<br>ALEWLANIWWDDGCCYSTSLKTRLTISKDTSKNQVVLTMTNMDPV<br>DTATYYCARIESIGTTYSFDYWGQGTMVTVSS |
| CL-22588 | 2732 | EVTLRESGPALVKPTQTLTLTCTFSGFSLSTSGMRVGWIRQPPGK<br>ALEWLALIDWCDDKYYSTSLKTRLTISKDTSKNQVVLTMTNMDPV<br>DTATYYCARIESIGTTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22589 | 2733 | EVTLRESGPALVKPTQTLTLTCTFSGFSLSTSGMGVSWIRQPPGK<br>ALEWLALIDWDDHXHYSTSLKTRLTISKDTSKNQVVLTMTNMDPV<br>DTATYYCARIESIGTTYSFDYWGQGTMVTVSS |
| CL-22591 | 2734 | EVTLRESGPALVKPTQTLTLTCTFSGFSLWTSGVGVGWIRQPPGK<br>ALEWLALIDWEDNKDYSTSLKTRLTISKDTSKNQVVLTMTNMDPV<br>DTATYYCARIESIGTTYSFDYWGQGTMVTVSS |
| CL-22593 | 2735 | EVTLRESGPALVKPTQTLTLTCTFSGFSLSTSGVRVGWIRQPPGK<br>ALEWLALIDWVDDMYYSTSLKTRLTISKDTSKNQVVLTMTNMDPV<br>DTATYYCARIESIGTTYSFDYWGQGTMVTVSS |
| CL-22595 | 2736 | EVTLRESGPALVKPTQTLTLTCTFSGFSLSTYGMGVEWIRQPPGK<br>ALEWLALIDWDDDKDYNPSLKNRLTISKDTSKNQVVLTMTNMDPV<br>DTATYYCARIESIGTTYSFDYWGQGTMVTVSS |
| CL-22596 | 2737 | EVTLRESGPALVKPTQTLTLTCTFSGFSLSTSGMGVGWIRQPPGK<br>ALEWLALIDWCDNRYYSTSLKTRLTISKDTSKNQVVLTMTNMDPV<br>DTATYYCARIESIGTTYSFDYWGQGTMVTVSS |
| CL-22597 | 2738 | EVTLRESGPALVKPTQTLTLTCTFSGFSLSTSGMRVGWIRQPPGK<br>ALEWLALIDWDDDKYYNPSLKNRLTISKDTSKNQVVLTMTNMDPV<br>DTATYYCARIESIGTTYSFDYWGQGTMVTVSS |
| CL-22598 | 2739 | EVTLRESGPALVKPTQTLTLTCTFSGFSLRTYGVSVGWIRQPPGK<br>ALEWLALIDWYDGKYYNPSLKNRLTISKDTSKNQVVLTMTNMDPV<br>DTATYYCARIESIGTTYSFDYWGQGTMVTVSS |
| CL-22599 | 2740 | EVTLRESGPALVKPTQTLTLTCTFSGFSLSTYGMGVDWIRQPPGK<br>ALEWLALIDWEDDKSYSTSLKTRLTISKDTSKNQVVLTMTNMDPV<br>DTATYYCARIESIGTTYSFDYWGQGTMVTVSS |
| CL-22600 | 2741 | EVTLRESGPALVKPTQTLTLTCTFSGFSLWTYGVSVRWIRQPPGK<br>ALEWLALIDWDDVKYYSTSLKTRLTISKDTSKNQVVLTMTNMDPV<br>DTATYYCARIESIGTTYSFDYWGQGTMVTVSS |
| CL-22601 | 2742 | EVTLRESGPALVKPTQTLTLTCTFSGFSLSTSGVGVGWIRQPPGK<br>ALEWLALIDWDDDKFYSTSLKTRLTISKDTSKNQVVLTMTNMDPV<br>DTATYYCARIESIGTTYSFDYWGQGTMVTVSS |
| CL-22602 | 2743 | EVTLRESGPALVKPTQTLTLTCTFSGFSLPTYGVRVGWIRQPPGK<br>ALEWLANIWWVDNKYYSTSLKTRLTISKDTSKNQVVLTMTNMDPV<br>DTATYYCARIESIGTTYSFDYWGQGTMVTVSS |
| CL-22603 | 2744 | EVTLRESGPALVKPTQTLTLTCTFSGFSLXTSGVRVGWIRQPPGK<br>ALEWLALIDWDDYQYYNPSLKNRLTISKDTSKNQVVLTMTNMDPV<br>DTATYYCARIESIGTTYSFDYWGQGTMVTVSS |
| CL-22604 | 2745 | EVTLRESGPALVKPTQTLTLTCTFSGFSLSTYGVSVGWIRQPPGK<br>ALEWLANIWWYDLKYYSTSLKTRLTISKDTSKNQVVLTMTNMDPV<br>DTATYYCARIESIGTTYSFDYWGQGTMVTVSS |
| CL-22605 | 2746 | EVTLRESGPALVKPTQTLTLTCTFSGFSLSTYGVGVGWIRQPPGK<br>ALEWLALIDWDDDKCYNPSLKNRLTISKDTSKNQVVLTMTNMDPV<br>DTATYYCARIESIGTTYSFDYWGQGTMVTVSS |
| CL-22606 | 2747 | EVTLRESGPALVKPTQTLTLTCTFSGFSLSTSGVSVGWIRQPPGK<br>ALEWLANIWWDDEKAYSTSLKTRLTISKDTSKNQVVLTMTNMDPV<br>DTATYYCARIESIGTTYSFDYWGQGTMVTVSS |
| CL-22607 | 2748 | EVTLRESGPALVKPTQTLTLTCTFSGFSLSTSGVGVSWIRQPPGK<br>ALEWLALIDWDDDKYYNPSLKNRLTISKDTSKNQVVLTMTNMDPV<br>DTATYYCARIESIGTTYSFDYWGQGTMVTVSS |
| CL-22608 | 2749 | EVTLRESGPALVKPTQTLTLTCTFSGFSLSTYGMGVGWIRQPPGK<br>ALEWLALIDWDDDKYYSTSLKTRLTISKDTSKNQVVLTMTNMDPV<br>DTATYYCARIESIGTTYSFDYWGQGTMVTVSS |
| CL-22609 | 2750 | EVTLRESGPALVKPTQTLTLTCTFSGFSLPTSGVSVGWIRQPPGK<br>ALEWLANIWWADSKFYSTSLKNRLTISKDTSKNQVVLTMTNMDPV<br>DTATYYCARIESIGTTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22610 | 2751 | EVTLRESGPALVKPTQTLTLTCTFSGFSLSTYGVSVDWIRQPPGK<br>ALEWLALIDWGDQTNYNPSLKNRLTISKDTSKNQVVXTMTNMDPV<br>DTATYYCARIESIGTTYSFDYWGQGTMVTVSS |
| CL-22611 | 2752 | EVTLRESGPALVKPTQTLTLTCTFSGFSLSTYGVGVEWIRQPPGK<br>ALEWLALIDWYDDKYYSTSLKTRLTISKDTSKNQVVLTMTNMDPV<br>DTATYYCARIESIGTTYSFDYWGQGTMVTVSS |
| CL-22612 | 2753 | EVTLRESGPALVKPTQTLTLTCTFSGFSLPTSGVGVGWIRQPPGK<br>ALEWLALIDWEDHMDYSTSLKTRLTISKDTSKNQVVLTMTNMDPV<br>DTATYYCARIESIGTTYSFDYWGQGTMVTVSS |
| CL-22614 | 2754 | EVTLRESGPALVKPTQTLTLTCTFSGFSLSTYGMRVGWIRQPPGK<br>ALEWLALIDWXDDKYYNPSLKNRLTISKDTSKNQVVLTMTNMDPV<br>DTATYYCARIESIGTTYSFDYWGQGTMVTVSS |
| CL-22615 | 2755 | EVTLRESGPALVKPTQTLTLTCTFSGFSLTTSGVGVGWIRQPPGK<br>ALEWLALIDWYDERFYSTSLKTRLTISKDTSKNQVVLTMTNMDPV<br>DTATYYCARIESIGTTYSFDYWGQGTMVTVSS |
| CL-22617 | 2756 | EVTLRESGPALVKPTQTLTLTXTFSGFSLSTYGMRVGWIRQPPGK<br>ALEWLANIWWADNXSYSTSLKTRLTISKDTSKNQVVLTMTNMDPV<br>DTATYYCARIESIGTTYSFDYWGQGTMVTVSS |
| CL-22618 | 2757 | EVTLRESGPALVKPTQTLTLTCTFSGFSLSTYGMSVGWIRQPPGK<br>ALEWLALIDWADDNYYSTSLKTRLTISKDTSKNQVVLTMTNMDPV<br>DTATYYCARIESIGTTYSFDYWGQGTMVTVSS |
| CL-22619 | 2758 | EVTLRESGPALVKPTQTLTLTCTFSGFSLSTSGVSVGWIRQPPGK<br>ALEWLALIDWEDDKYYNPSLKNRLTISKDTSKNQVVLTMTNMDPV<br>DTATYYCARIESIGTTYSFDYWGQGTMVTVSS |
| CL-22620 | 2759 | EVTLRESGPALVKPTQTLTLTCTFSGFSLWTSGMGVGWIRQPPGK<br>ALEWLALIDWDDEKAYNPSLKNRLTISKDTSKNQVVLTMTNMDPV<br>DTATYYCARIESIGTTYSFDYWGQGTMVTVSS |
| CL-22621 | 2760 | EVTLRESGPALVKPTQTLTLTCTFSGFSLWTSGMRVGWIRQPPGK<br>ALEWLANIWWDDDKYYSTSLKTRLTISKDTSKNQVVLTMTNMDPV<br>DTATYYCARIESIGTTYSFDYWGQGTMVTVSS |
| CL-22622 | 2761 | EVTLRESGPALVKPTQTLTLTCTFSGFSLSTYGVSVGWIRQPPGK<br>ALEWLALIDWHDDKYYNPSLKNRLTISKDTSKNQVVLTMTNMDPV<br>DTATYYCARIESIGTTYSFDYWGQGTMVTVSS |
| CL-22624 | 2762 | EVTLRESGPALVKPTQTLTLTCTFSGFSLSTYGMSVGWIRQPPGK<br>ALEWLALIDWNDNKYYNPSLKNRLTISKDTSKNQVVLTMTNMDPV<br>DTATYYCARIESIGTTYSFDYWGQGTMVTVSS |
| CL-22625 | 2763 | EVTLRESGPALVKPTQTLTLTCTFSGFSLSTSGVGVGWIRQPPGK<br>ALEWLALIDWDDDKYYSTSLKTRLTISKDTSKNQVVLTMTNMDPV<br>DTATYYCARIESIGTTYSFDYWGQGTMVTVSS |
| CL-22626 | 2764 | EVTLRESGPALVKPTQTLTLTCTFSGFSLSTSGVRVCWIRQPPGK<br>ALEWLALIDWDDDKSYNPSLKNRLTISKDTSKNQVVLTMTNMDPV<br>DTATYYCARIESIGTTYSFDYWGQGTMVTVSS |
| CL-22627 | 2765 | EVTLRESGPALVKPTQTLTLTCTFSGFSLSTYGVSVTWIRQPPGK<br>ALEWLALIDWNDDNHYSTSLKTRLTISKDTSKNQVVLTMTNMDPV<br>DTATYYCARIESIGTTYSFDYWGQGTMVTVSS |
| CL-22628 | 2766 | EVTLRESGPALVKPTQTLTLTCTFSGFSLSTSGVSVVWIRQPPGK<br>ALEWLANIWWDDEKCYSTSLKTRLTISKDTSKNQVVLTMTNMDPV<br>DTATYYCARIESIGTTYSFDYWGQGTMVTVSS |
| CL-22629 | 2767 | EVTLRESGPALVKPTQTLTLTCTFTGFSLYTSGMGVGWIRQPPGK<br>ALEWLALIDWDDDKNYSTSLKTRLTISKDTSKNQVVLTMTNMDPV<br>DTATYYCARIESIGTTYSFDYWGQGTMVTVSS |
| CL-22630 | 2768 | EVTLRESGPALVKPTQTLTLTCTFSGFSLFTYGVGVDWIRQPPGK<br>ALEWLANIWWPDDNYYSTSLKTRLTISKDTSKNQVVLTMTNMDPV<br>DTATYYCARIESIGTTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22631 | 2769 | EVTLRESGPALVKPTQTLTLTCTFSGFSLSTSGVGVGWIRQPPGK<br>ALEWLALIDWDDDXCYNPSLKNRLTISKDTSKNQVVLTMTNMDPV<br>DTATYYCARIESIGTTYSFDYWGQGTMVTVSS |
| CL-22633 | 2770 | EVTLRESGPALVKPTQTLTLTCTFSGFSLSTYGVSVGWIRQPPGK<br>ALEWLALIDWDDEKYYNPSLKNRLTISKDTSKNQVVLTMTNMDPV<br>DTATYYCARIESIGTTYSFDYWGQGTMVTVSS |
| CL-22634 | 2771 | EVTLRESGPALVKPTQTLTLTCTFSGFSLSTSGVGVGWIRQPPGK<br>ALEWLALIDWIDDEDYSTSLKTRLTISKDTSKNQVVLTMTNMDPV<br>DTATYYCARIESIGTTYSFDYWGQGTMVTVSS |
| CL-22635 | 2772 | EVTLRESGPALVKPTQTLTLTCTFSGFSLSTSGVSVRWIRQPPGK<br>ALEWLANIWWDDNKYYSTSLKTRLTISKDTSKNQVVLTMTNMDPV<br>DTATYYCARIESIGTTYSFDYWGQGTMVTVSS |
| CL-22636 | 2773 | EVTLRESGPALVKPTQTLTLTCTFSGFSLCTSGMGVGWIRQPPGK<br>ALEWLANIWWDDDNYYSTSLKTRLTISKDTSKNQVVLTMTNMDPV<br>DTATYYCARIESIGTTYSFDYWGQGTMVTVSS |
| CL-22637 | 2774 | EVTLRESGPALVKPTQTLTLTCTFSGFSLLTYGMGVGWIRQPPGK<br>ALEWLANIWWHDDKYYSTSLKTRLTISKDTSKNQVVLTMTNMDPV<br>DTATYYCARIESIGTTYSFDYWGQGTMVTVSS |
| CL-22638 | 2775 | EVTLRESGPALVKPTQTLTLTCTFSGFSLSTSGVSVAWIRQPPGK<br>ALEWLANIWWDDDKYYSTSLKNRLTISKDTSKNQVVLTMTNMDPV<br>DTATYYCARIESIGTTYSFDYWGQGTMVTVSS |
| CL-22639 | 2776 | EVTLRESGPALVKPTQTLTLTCTFSGFSLSTSGVRVGWIRQPPGK<br>ALEWLALIDWEDYLCYNPSLKNRLTISKDTSKNQVVLTMTNMDPV<br>DTATYYCARIESIGTTYSFDYWGQGTMVTVSS |
| CL-22640 | 2777 | EVTLRESGPALVKPTQTLTLTCTFSGFSLSTSGVGVGWIRQPPGK<br>ALEWLALIDWDDDYYSTSLKTRLTISKDTSKNQVVLTMTNMDPV<br>DTATYYCARIESIGTTYSFDYWGQGTMVTVSS |
| CL-22641 | 2778 | EVTLRESGPALVKPTQTLTLTCTFSGFSLSTYGMGVGWIRQPPGK<br>ALEWLANIWWDDDKYYSTSLKTRLTISKDTSKNQVVLTMTNMDPV<br>DTATYYCARIESIGTTYSFDYWGQGTMVTVSS |
| CL-22642 | 2779 | EVTLRESGPALVKPTQTLTLTCTFSGFSLSTSGMGVGWIRQPPGK<br>ALEWLANIWWVDDNYYSTSLKTRLTISKDTSKNQVVLTMTNMDPV<br>DTATYYCARIESIGTTYSFDYWGQGTMVTVSS |
| CL-22643 | 2780 | EVTLRESGPALVKPTQTLTLTCTFSGFSLSTYGMGVYWIRQPPGK<br>ALEWLALIDWDDDNYYNPSLKNRLTISKDTSKNQVVLTMTNMDPV<br>DTATYYCARIESIGTTYSFDYWGQGTMVTVSS |
| CL-22644 | 2781 | EVTLRESGPALVKPTQTLTLTCTFSGFSLSTSGVSVGWIRQPPGK<br>ALEWLALIDWDDGKYYSTSLKTRLTISKDTSKNQVVLTMTNMDPV<br>DTATYYCARIESIGTTYSFDYWGQGTMVTVSS |
| CL-22645 | 2782 | EVTLRESGPALVKPTQTLTLTCTFSGFSLSTSGVRVVWIRQPPGK<br>ALEWLALIDWNDDKYYNPSLKNRLTISKDTSKNQVVLTMTNMDPV<br>DTATYYCARIESIGTTYSFDYWGQGTMVTVSS |
| CL-22646 | 2783 | EVTLRESGPALVKPTQTLTLTCTFSGFSLSTSGVSVVWIRQPPGK<br>ALEWLANIWWHDDKYYSTSLKTRLTISKDTSKNQVVLTMTNMDPV<br>DTATYYCARIESIGTTYSFDYWGQGTMVTVSS |
| CL-22648 | 2784 | EVTLRESGPALVKPTQTLTLTCTFSGFSLMTSGMSVCWIRQPPGK<br>ALEWLANIWWYDHKYYSTSLKTRLTISKDTSKNQVVLTMTNMDPV<br>DTATYYCARIESIGTTYSFDYWGQGTMVTVSS |
| CL-22649 | 2785 | EVTLRESGPALVKPTQTLTLTCTFSGFSLRTYGVSVGWIRQPPGK<br>ALEWLANIWWDDAKYYSTSLKTRLTISKDTSKNQVVLTMTNMDPV<br>DTATYYCARIESIGTTYSFDYWGQGTMVTVSS |
| CL-22650 | 2786 | EVTLRESGPALVKPTQTLTLTCTFSGFSLSTYGVRVAWIRQPPGK<br>ALEWLANIWWDDVKYYSTSLKTRLTISKDTSKNQVVLTMTNMDPV<br>DTATYYCARIESIGTTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22651 | 2787 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIAASYSFDYWGQGTMVTVSS |
| CL-22652 | 2788 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARFEYLGAMYXFDYWGQGTMVTVSS |
| CL-22653 | 2789 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARXDSFRKPYSFDYWGQGTMVTVSS |
| CL-22654 | 2790 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIXSIGSTYWFDYWGQGTMVTVSS |
| CL-22655 | 2791 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARLVSIVTKYSFDYWGQGTMVTVSS |
| CL-22656 | 2792 | XVTLXESGPALXKPTXTLTLTCTFSGFXLSTXGMGVGWIRQPPRK ALXWLANXWWDDDKYYNPSLXNRLXISKDTSKNQVVLTMTNMDPV DTAXYYCARXXXXXMXYSFDYWGQGTMVTXSX |
| CL-22658 | 2793 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARLEPIPMTYSFDYWGQGTMVTVSS |
| CL-22659 | 2794 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIEWSAITYSFDYWGQGTMVTVSS |
| CL-22660 | 2795 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIECTXNRYXFDYWGQGTMVTVSS |
| CL-22661 | 2796 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIECNSTTYSFDYWGQGTMVTVSS |
| CL-22664 | 2797 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARLASLCATYYFDYWGQGTMVTVSS |
| CL-22665 | 2798 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIGWRLRMYSFDYWGQGTMVTVSS |
| CL-22666 | 2799 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIVSIGGTYSFDYWGQGTMVTVSS |
| CL-22668 | 2800 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARVESIGTTYYFDYWGQGTMVTVSS |
| CL-22669 | 2801 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARYAPIGTTYWFDYWGQGTMVTVSS |
| CL-22670 | 2802 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESTRTTYLFDYWGQGTMVTVSS |
| CL-22671 | 2803 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESTGTAYSFDYWGQGTMVTVSS |
| CL-22672 | 2804 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIASVGTSYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22673 | 2805 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCAREESTCPTYYFDYWGQGTMVTVSS |
| CL-22675 | 2806 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARTESIDRAYSFDYWGQGTMVTVSS |
| CL-22677 | 2807 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIGSTGISYSFDYWGQGTMVTVSS |
| CL-22678 | 2808 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARRESIGTTYSFDYWGQGTMVTVSS |
| CL-22679 | 2809 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARKVTIETAYYFDYWGQGTMVTVSS |
| CL-22680 | 2810 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATXYCARFASIGTTYSFDYWGQGTMVTVSS |
| CL-22681 | 2811 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARMKSIATTYSFDYWGQGTMVTVSS |
| CL-22682 | 2812 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRRATYSFDYWGQGTMVTVSS |
| CL-22683 | 2813 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIGXIGSAYTFDYWGQGTMVTVSS |
| CL-22685 | 2814 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARTGSGVTTYSFDYWGQGTMVTVSS |
| CL-22688 | 2815 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIGSIESAYSFDYWGQGTMVTVSS |
| CL-22689 | 2816 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARVYSKGTTYSFDYWGQGTMVTVSS |
| CL-22691 | 2817 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARFEALGLSYSFDYWGQGTMVTVSS |
| CL-22692 | 2818 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATXYCARRGTIRTTYSFDYWGQGTMVTVSS |
| CL-22694 | 2819 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIYWIGPTYCFDYWGQGTMVTVSS |
| CL-22695 | 2820 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMRTTYSFDYWGQGTMVTVSS |
| CL-22696 | 2821 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIRSIVTTYSFDYWGQGTMVTVSS |
| CL-22698 | 2822 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARTQSSAMTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22702 | 2823 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARNESMGTSYSFDYWGQGTMVTVSS |
| CL-22703 | 2824 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEFVRAIYSFDYWGQGTMVTVSS |
| CL-22704 | 2825 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARFESLGETYSFDYWGQGTMVTVSS |
| CL-22705 | 2826 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEAIGNQYSFDYWGQGTMVTVSS |
| CL-22706 | 2827 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARKDSMVTTYLFDYWGQGTMVTVSS |
| CL-22707 | 2828 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARVEWQGSTYSFDYWGQGTMVTVSS |
| CL-22708 | 2829 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYMFDYWGQGTMVTVSS |
| CL-22709 | 2830 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARCASVSTTYCFDYWGQGTMVTVSS |
| CL-22710 | 2831 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARILSIGNTYSFDYWGQGTMVTVSS |
| CL-22711 | 2832 | EVTLRESGPALVKPTQTLTLTCTFFGFSLSTYGMGVGWIRQPPGK<br>ALEWLANIWCDDDKYYNPSLKNRLTISKDTSKNQVVLTMTNMDPV<br>DTATYYCARIESNGNTYSFDYWGQGTMVTVSS |
| CL-22712 | 2833 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARRDSTGTPYSFDYWGQGTMVTVSS |
| CL-22713 | 2834 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARVESIVTTYYFDYWGQGTMVTVSS |
| CL-22714 | 2835 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARLEKFGRTYPFDYWGQGTMVTVSS |
| CL-22715 | 2836 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARFKSNRPSYSFDYWGQGTMVTVSS |
| CL-22716 | 2837 | EVTLRESGPALVKPTQTLTLTCTFSGFSLSTYGMGVGWIRQPPGK<br>ALEWLANIWWDDDKYYNPSXKNRLXISKDTSKNQVVLTMTNMDPV<br>DTATYYCARIESLDTTYXFDXXGQGXMXTVSS |
| CL-22717 | 2838 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIXATGMLYSFDYWGQGTMVTVSS |
| CL-22718 | 2839 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIETTYXFDYWGQGTMVTVSS |
| CL-22719 | 2840 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEXMAPMYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-22720 | 2841 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARVRPLVTIYSFDYWGQGTMVTVSS |
| CL-22721 | 2842 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIDSVWTTYSFDYWGQGTMVTVSS |
| CL-22722 | 2843 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARVEEIGNTYNFDYWGQGTMVTVSS |
| CL-22723 | 2844 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARRGLFRIRYSFDYWGQGTMVTVSS |
| CL-22724 | 2845 | EVTLRESGPALVKPTQTLTLTCTFSGFSLSTYGMGVGWIRQPPGK<br>ALEWLANIWWDDDKYYNPSLKNRXTISKDTSKNQVVLTMTNMDPV<br>DTATYYCARIESIGTTYSFDYWGQGTMVTVSS |
| CL-22725 | 2846 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEVIGTAYSFDYWGQGTMVTVSS |
| CL-22726 | 2847 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARLDVIGMLYAFDYWGQGTMVTVSS |
| CL-22728 | 2848 | EVTLRESGPALVKPTKTLTLTCTFSGFSLSTYGMGVGWIRQPPGK<br>ALEWLANIWWDDDKYYNPSLKNRLTISKDTSKNQVVLTMTNMDPV<br>DTATYYCARIMSIGSSYXFDYWGQGTMVTVSS |
| CL-22729 | 2849 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIDWIGTTYSFDYWGQGTMVTVSS |
| CL-22730 | 2850 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARNSSIGSTYSFDYWGQGTMVTVSS |
| CL-22731 | 2851 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESPGTWYSFDYWGQGTMVTVSS |
| CL-22732 | 2852 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEWIGITYCFDYWGQGTMVTVSS |
| CL-22733 | 2853 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEXLGTTYSFDYWGQGTMVTVSS |
| CL-22734 | 2854 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARKELTCSTYSFDYWGQGTMVTVSS |
| CL-22736 | 2855 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEXIRMRYSFDYWGQGTMVTVSS |
| CL-22737 | 2856 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARKAAIATLYLFDYWGQGTMVTVSS |
| CL-22738 | 2857 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARRRPIVTTYSFDYWGQGTMVTVSS |
| CL-22740 | 2858 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTVYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-22741 | 2859 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIASIGSMYSFDYWGQGTMVTVSS |
| CL-22742 | 2860 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESRATTYSFDYWGQGTMVTVSS |
| CL-22743 | 2861 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARNVWLGTTYSFDYWGQGTMVTVSS |
| CL-22744 | 2862 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIMSIGTAYSFDYWGQGTMVTVSS |
| CL-22745 | 2863 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIKWIWTTYSFDYWGQGTMVTVSS |
| CL-22746 | 2864 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIEXRGSTYIFDYWGQGTMVTVSS |
| CL-22759 | 2865 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCXRIESIGTTYSFDYWGQGTMVTVSS |
| CL-22763 | 2866 | EVTLRESGPALVKPTQTLTLTCTFSGFSLSTYGMGVGWIRQPPGK ALEWLANIWWDDDKYYNPSLKNRLTISKDTSKNQVVLTMTNXDPV DTATYYCARIESIGTTYSFDYWGQGTMVTVSS |
| CL-22806 | 2867 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGTTYXFXYWGQGTMVTVSS |
| CL-22812 | 2868 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATXYCARIESIGTTYSFDYXGQGTMVTVSS |
| CL-22819 | 2869 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCAXIESIGTTYSFDYWGQGTMVTVSS |
| CL-22833 | 2870 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYXCARIESIGTTYSXDYWGQGTXVTVSS |
| CL-25629 | 2871 | EVTLRESGPALVKPTQTLTLTCTFSGFSLSTYGMGVGWIRKPPGK ALEWLANIWWDDDKYYNPSLKNRLTISKDTSKNQVVLTMTNMDPV DTATYYCARIESIGTTYSFDYWGQGTMVTVSS |
| CL-25633 | 2872 | EVTLRESGPALVKPTQTLTLTCTFSGFSLSTYGMGVGWIRQPPGK ALEWLANIWWDDDKYYNPSLKNRLTISKDTSKNQVVLTMTNVDPV DTATYYCARIESIGTTYSFDYWGQGTMVTVSS |
| CL-25645 | 2873 | EVTLRESGPALVKPTQTLTLTCTFSGFSLSTYGMGVGWIRQPPGK ELEWLANIWWDDDKYYNPSLKNRLTISKDTSKNQVVLTMTNMDPV DTATYYCARIESIGTTYSFDYWGQGTMVTVSS |
| CL-25649 | 2874 | EVTLRESGPALVKPTQTLTLTCTFSGFSLATSGMGVGWIRQPPGK ALEWLANIWWDDDKYYNPSLKNRLTISKDTSKNQVVLTMTNMDPV DTATYYCARIESIGTTYSFDYWGQGTMVTVSS |
| CL-25656 | 2875 | EVTLRESGPALVKPTQTLTLTCTFSGFRLSTYGMGVGWIRKPPGK ALEWLANIWWDDDKYYNPSLKNRLTISKDTSKNQVVLTMTNMDPV DTATYYCARIESIGTTYSFDYWGQGTMVTVSS |
| CL-25657 | 2876 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTANYYCARIASIPTMYAFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-25676 | 2877 | EVTLRESGPALVKPTQTLTLTCTFSGFSLSTYGMGVGWIRQPPGK ALEWMANIWWDDDKYYNPSLKNRLTISKDTSKNQVVLTMTNMDPV DTATYYCARIESIGTTYSFDYWGQGTMVTVSS |
| CL-25679 | 2878 | EVTLRESGPALVKPTQTLTLTCTFSGFSLSTYGMGVGWIRQPPGK ALEWLANIWWDHDKYYNPSLKNRLTISKDTSKNQVVLTMTNMDPV DTATYYCARIESIGTTYSFDYWGQGTMVTVSS |
| CL-25684 | 2879 | EVTLRESGPALVKPTQTLTLTCTFSGFSLSTSGMGVGWIRQPPGK ALEWLANIWWDDDKYYNPSLKTRLTISKDTSKNQVVLTMTNMDPV DTATYYCARIESIGTTYSFDYWGQGTMVTVSS |
| CL-25696 | 2880 | EVTLRESGPALVKPTQTLTLTCTFSGFSLSTYGVGVGWIRQPPGK ALEWLANIWWDDDKYYSTSLKTRLTISKDTSKNQVVLTMTNMDPV DTATYYCARIESIGTTYSFDYWGQGTMVTVSS |
| CL-25697 | 2881 | EVTLRESGPALVKPTQTLTLTCTFSGFSLSTYGMGVGWIRKPPGK ALEWLANIWWDDDKYYNPSLKTRLTISKDTSKNQVVLTMTNMDPV DTATYYCARIESIGTTYSFDYWGQGTMVTVSS |
| CL-25699 | 2882 | EVTLRESGPALVKPTQTLTLTCTFSGFSLSTSGMGVGWIRQPPGK ALEWLANIWWDDDRYYNPSLKNRLTISKDTSKNQVVLTMTNMDPV DTATYYCARIESIGTTYSFDYWGQGTMVTVSS |
| CL-25700 | 2883 | EVTLRESGPALVKPTQTLTLTCTFSGFSLMTYGMGVGWIRQPPGK ALEWLANIWWDDDKYYNPSLKNRLTISKDTSKNQVVLTMTNMDPV DTATYYCARIESIGTTYSFDYWGQGTMVTVSS |
| CL-25702 | 2884 | EVTLRESGPALVKPTQTLTLTCTFSGFSLSTYGMGVGWIRQPPGK ALEWLANIWWDDDKYYNTSLKNRLTISKDTSKNQVVLTMTNMDPV DTATYYCARIESIGTTYSFDYWGQGTMVTVSS |
| CL-25710 | 2885 | EVTLRESGPALVKPTQTLTLTCTFSGFSLSTYGMGVGWIRQPPGK ALEWLENIWWDDDKYYNPSLKNRLTISKDTSKNQVVLTMTNMDPV DTATYYCARIESIGTTYSFDYWGQGTMVTVSS |
| CL-25738 | 2886 | EVTLKKSGPALVKPXQTLTLTCTFSGFSLSTYGMGVGWIRXPPGK GLEWLANIWWDDDKYYNPSLKNRLTIXKDTSKNQVVLTMTNMDPV DTATYYCARIESIGTTYSFDYWGQGTMVTVSS |
| CL-25739 | 2887 | EVTLKESGPALVKPTXTLTLTCTFSGFSLSTYGMGVGWIRQPPGK ALEWLANIWWDDDKYYNPSLKNRLTISKDTSKNQVVLTMTNMDPV DTATYYCARIESIGTTYSFDYWGQGTMVTVSS |
| CL-25745 | 2888 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGTTYSFDYWGQGTMVTVSX |
| CL-25749 | 2889 | EVTLRESGPALVKPTXTLTLTCTFSGFSLSTYGMGVGWIRQPPGK ALEWLANIWWDDDKYYNPSLKNRLTISKDTSKNQVVLTMTNMDPV DTATYYCARIESIGTTYSFDYWGQGTMVTVSS |
| CL-25755 | 2890 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARMKSIGSTYSFDYWGQGTMVTVSS |
| CL-25763 | 2891 | EVTLKESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGTTYSFDYWGQGTMVTVSS |
| CL-25765 | 2892 | EVTLRESGPALVKPTXTLTLTCTFSGFSLSTYGMGVGWIRQPPGK ALEWLANIWWDDDKYYNPSLKNRLTISKDTSKNQVVLTMTNMDPV DTATYYCARIESIGTTYSFDYWGQGXMVTVSS |
| CL-25769 | 2893 | EVTLKESGPALVKPTXTLTLTCTFSGFSLSTYGMGVGWIRHPPGK ALEWLANIWWNNDNYYNPSLKNRLTINKDTSKNQVVLTMTNMDPV DTATYYCARIESIGTTYSFDYWGQGTMVTVSS |
| CL-25773 | 2894 | EVTLKESGPALVKPTQTLTLTCTFSGFSLSTYGMGVGWIRQPPGK ALEGLANIWWDDDKYYNPSLKNRLTINKDTSKNQVVLTMTNMDPV DTATYYCARIESIGTTYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-25789 | 2895 | EVTLRESGPALVKPTHTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |
| CL-25791 | 2896 | EVTLKESGPALVKPTQTLTLTCTFSGFRLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |
| CL-25797 | 2897 | EVTLXESGPALVKPTXTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |
| CL-25815 | 2898 | EVTLKESGPALVKPTQTLTLTCTFSGFSLSTYGMGVGWIRQPPGK<br>ALEWLANIWWDDDKYYNPSLKNRLTINKDTSKNQVVLTMTNMDPV<br>DTATYYCARIESIGTTYSFDYWGQGTMVTVSS |
| CL-28144 | 2899 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESGWTTYSFDYWGQGTMVTVSS |
| CL-28145 | 2900 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIWTSYSFDYWGQGTMVTVSS |
| CL-28146 | 2901 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSSWTIYSFDYWGQGTMVTVSS |
| CL-28147 | 2902 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIYSSGTVYSFDYWGQGTMVTVSS |
| CL-28148 | 2903 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGISYSFDYWGQGTMVTVSS |
| CL-28149 | 2904 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTGTSYSFDYWGQGTMVTVSS |
| CL-28151 | 2905 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGPSYSFDYWGQGTMVTVSS |
| CL-28152 | 2906 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGSSYSFDYWGQGTMVTVSS |
| CL-28155 | 2907 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSIGWSYSFDYWGQGTMVTVSS |
| CL-28156 | 2908 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIYSDWTIYSFDYWGQGTMVTVSS |
| CL-28157 | 2909 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWITYSFDYWGQGTMVTVSS |
| CL-28160 | 2910 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESEWTTYNFDYWGQGTMVTVSS |
| CL-28161 | 2911 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPTTYSFDYWGQGTMVTVSS |
| CL-28162 | 2912 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGISYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-28163 | 2913 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSATIYSFDYWGQGTMVTVSS |
| CL-28164 | 2914 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTGTTYSFDYWGQGTMVTVSS |
| CL-28167 | 2915 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTSYSFDYWGQGTMVTVSS |
| CL-28169 | 2916 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSTWTTYSFDYWGQGTMVTVSS |
| CL-28170 | 2917 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGTSYNFDYWGQGTMVTVSS |
| CL-28173 | 2918 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTWWTYSFDYWGQGTMVTVSS |
| CL-28175 | 2919 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSGWSYAFDYWGQGTMVTVSS |
| CL-28177 | 2920 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGYSYSFDYWGQGTMVTVSS |
| CL-28180 | 2921 | EVTLRESGPALVKPTQTLTLTCTFSGFSLSTYGMGVGWIRQPPGK<br>ALEWMANIWWDDDKYYNPSLKNRLTISKDTSKNQVVLTMTNMDPV<br>DTATYYCARIETLGISYSFDYWGQGTMVTVSS |
| CL-28181 | 2922 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMWSSYSFDYWGQGTMVTVSS |
| CL-28182 | 2923 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETIGTSYSFDYWGQGTMVTVSS |
| CL-28186 | 2924 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSDVTTYSFDYWGQGTMVTVSS |
| CL-28187 | 2925 | EVTLRESGPALVKPTKTLTLTCTFSGFSLSTYGMGVGWIRQPPGK<br>ALEWLANIWWDDDKYYNPSLKNRLTISKDTSKNQVVLTMTNMDPV<br>DTATYYCARIESFGTSYSFDYWGQGTMVTVSS |
| CL-28189 | 2926 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIKSIGWTYSFDYWGQGTMVTVSS |
| CL-28190 | 2927 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNFWSYSFDYWGQGTMVTVSS |
| CL-28195 | 2928 | EVTLRESGPALVKPTHTLTLTCTFSGFSLSTYGMGVGWIRQPPGK<br>ALEWLANIWWDDDKYYNPSLKNRLTISKDTSKNQVVLTMTNMDPV<br>DTATYYCARIMSLETRYDFYYWGQGTMVTVSS |
| CL-28196 | 2929 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVETSYNFDYWGQGTMVTVSS |
| CL-28198 | 2930 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESFWTTYSFDYWGQGTMVTVSS |

TABLE 46-continued

List of amino Acid Sequences Of Affinity Matured hBDI-9E8.4 VH Variants

| Clone | SEQ ID NO: | VH |
|-------|------------|-----|
| CL-28204 | 2931 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESMGTSYSFDYWGQGTMVTVSS |
| CL-28205 | 2932 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIWSSYSFDYWGQGTMVTVSS |
| CL-28208 | 2933 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGFSYSFDYWGQGTMVTVSS |
| CL-28212 | 2934 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESVGPSYSFDYWGQGTMVTVSS |
| CL-28213 | 2935 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESLGWTYSFDYWGQGTMVTVSS |
| CL-28215 | 2936 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESDWTTYSFDYWGQGTMVTVSS |
| CL-28219 | 2937 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGPSYSFDYWGQGTMVTVSS |
| CL-28233 | 2938 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESLVTSYDFDYWGQGTMVTVSS |
| CL-28235 | 2939 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESVGTSYNFDYWGQGTMVTVSS |
| CL-29595 | 2940 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESTEASYSFDYWGQGTMVTVSS |
| CL-29596 | 2941 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESNGASYSFDYWGQGTMVTVSS |
| CL-29597 | 2942 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESSVTTYSFDYWGQGTMVTVSS |
| CL-29598 | 2943 | EVTLRESGPALVKPTQTLTLTCTFSGFSLSTYGMGVGWIRQPPGK ALEWLANIWWDDDNYYNPSLKNRLTISKDTSKNQVVLTMTNMDPV DTATYYCARXESXWTSYSFDYWGQGTMVTVSS |
| CL-29600 | 2944 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGASYSFDYWGQGTMVTVSS |
| CL-29601 | 2945 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESTGRSYGFDYWGQGTMVTVSS |
| CL-29607 | 2946 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIETLGTSYSFDYWGQGTMVTVSS |
| CL-29608 | 2947 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESLGTTYSFDYWGQGTMVTVSS |
| CL-29611 | 2948 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIPTAYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-29612 | 2949 | EVTLRESGPALVKPTQTLTLTCTFSGFSLSTYGMGVGWIRQPPGK<br>ALEWLANIWWDDDKYYNPSLKTRLTISKDTSKNQVVLTMTNMDPV<br>DTATYYCARIESLGTTYSFDYWGQGTMVTVSS |
| CL-29613 | 2950 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARLESIATTYSFDYWGQGTMVTVSS |
| CL-29614 | 2951 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGPSYSFDYWGHGTMVTVSS |
| CL-29617 | 2952 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSYTSYSFDYWGQGTMVTVSS |
| CL-29618 | 2953 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTWTSYSFDYWGQGTMVTVSS |
| CL-29620 | 2954 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSVTNYQFDYWGQGTMVTVSS |
| CL-29621 | 2955 | EVTLRESGPALVKPTQTLTLICTFSGFSLSTYGMGVGWIRQPPGK<br>ALEWLANIWWDDDKYYNPSLKNRLTISKDTSKNQVVLTMTNMDPV<br>DTATYYCARIESIGTSYSFDYWGQGTMVTVSS |
| CL-29625 | 2956 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGPAYSFDYWGQGTMVTVSS |
| CL-29627 | 2957 | EVTLRESGPALVKPTQTLTLTCTFSGFSLSTYGMGVGWIRQPPGK<br>ALEWLANIWWDDDKYYNPSLKNRLTISKDTSNNQVVLTMTNMDPV<br>DTATYYCARIESFGSSYSFDYWGQGTMVTVSS |
| CL-29629 | 2958 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSETTYTFDYWGQGTMVTVSS |
| CL-29630 | 2959 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIWTTYSFDYWGQGTMVTVSS |
| CL-29631 | 2960 | EVTLRESGPALVKPTQTLTLTCTFSGFSLSTYGMGVGWIRQPPGK<br>ALEWLANIWWDDDKYYNPSLKNLLTISKDTSKNQVVLTMTNMDPV<br>DTATYYCARIESFGTSYSFDYWGQGTMVTVSS |
| CL-29632 | 2961 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIASXGTSYSFDYWGQGTMVTVSS |
| CL-29634 | 2962 | EVTLRESGPALVKPTQTLTLTCTFSGFSLSTYGMGVGWIRQPPGK<br>ALEWLANIWWDDEKYYSTSLKTRLTISKDTSKNQVVLTMTNMDPV<br>DTATYYCARIESIGTSYSFDYWGQGTMVTVSS |
| CL-29635 | 2963 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPTSYSFDYWGQGTMVTVSS |
| CL-29636 | 2964 | EVTLRESGPALVKPTQTLTLTCTFSGFSLSTSGMGVGWIRQPPGK<br>ALEWLANIWWDDDKYYNPSLKNRLTISKDTSKNQVVLTMTNMDPV<br>DTATYYCARIESIGWSYAFDYWGQGTMVTVSS |
| CL-29637 | 2965 | EVTLRESGPALVKPTQTLTLTCTFSGFSLSTYGMGVGWIRQPPGK<br>ALEWLANIWWDDDKYYNPSLKTRLTISKDTSKNQVVLTMTNMDPV<br>DTATYYCARIESIGWTYSFDYWGQGTMVTVSS |
| CL-29638 | 2966 | EVTLRESGPALVKPTQTLTLTCTFSGFSLATSGVSVLWIRQPPGK<br>ALEWLANIWWDDGXYYSTSLKTRLTISKDTSKNQVVLTMTNMDPV<br>DTATYYCARIESFGTSYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-29639 | 2967 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESLWTTYSFDYWGQGTMVTVSS |
| CL-29643 | 2968 | EVTLRESGPALVKPTQTLTLTCTFSGFSLDTYGMGVGWIRQPPGK ALEWLANIWWDDDKYYSTSLKTRLTISKDTSKNQVVLTMTNMDPV DTATYYCARIESSGYTYSFDYWGQGTMVTVSS |
| CL-29644 | 2969 | EVTLRESGPALVKPTQTLTLTCTFSGFSLTTYGMGVGWIRQPPGK ALEWLANIWWDDDKYYNPSLKNRLTISKDTSKNQVVLTMTNMDPV DTATYYCARIESSGSSYSFDYWGQGTMVTVSS |
| CL-29645 | 2970 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARVASSWVEYSFDYWGQGTMVTVSS |
| CL-29647 | 2971 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESFGTSYSFDYWGQGTMVTVSS |
| CL-29648 | 2972 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESSGTTYSFDYWGQGTMVTVSS |
| CL-29649 | 2973 | EVTLRESGPALVKPTQTLTLTCTFSGFSLSTYGMGVGWIRKPPGK ALEWLANIWWDDDKYYNPSLKNRLTISKDTSKNQVVLTMTNMDPV DTATYYCARIESMGISYSFDYWGQGTMVTVSS |
| CL-29651 | 2974 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESIGIAYSFDYWGQGTMVTVSS |
| CL-29654 | 2975 | EVTLRESGPALVKPTQTLTLTCTFSGFSLSTYGMGVGWIRQPPGK ALEWLANIXWDDDKYYNPSLKNRLTISKDTSKNQVVLTMTNMDPV DTATYYCARIESIVTTYSFDYWGQGTMVTVSS |
| CL-29658 | 2976 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESGWTIYSFDYWGQGTMVTVSS |
| CL-29662 | 2977 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESLGPTYSFDYWGQGTMVTVSS |
| CL-29663 | 2978 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESVGTSYSFDYWGQGTMVTVSS |
| CL-29665 | 2979 | EVTLRESGPALVKPTQTLTLTCTFSGFSLSTSGMGVGWIRQPPGK ALEWLANIWWDDDQYYNPSLKNRLTISKDTSKNQVVLTMTNMDPV DTATYYCARIESSWTTYSFDYWGQGTMVTVSS |
| CL-29667 | 2980 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESFGPSYSFDYWGQGTMVTVSS |
| CL-29668 | 2981 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARIESSGTSYSFDYWGQGTMVTVSS |
| CL-29673 | 2982 | EVTLRESGPALVKPTQTLTLTCTFSGFSLSTYGMGVGWIRQPPGK ALEWLANIWWDDDKYYNPSLKNRLTISKDTSKNQVVLTMTNMDPV DTATYYCARXXSIVTTYSFDYWGQGTMVTVSS |
| CL-29674 | 2983 | EVTLRESGPALVKPTQTLTLTCTFSGFSLSTYGMGVGWIRQPPGK ALEWLANIWWDDDKYYSTSLKTRLTISKDTSKNQVVLTMTNMDPV DTATYYCARIESIGTSYSFDYWGQGTMVTVSS |
| CL-29676 | 2984 | EVTLRESGPALVKPTQTLTLTCTFSGFSLSTYGMGVGLIRQPPGK ALEWLANIWWDDDKYYNPSLKNRLTISKDTSKNQVVLTMTNMDPV DTATYYCARIESVGTSYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-29678 | 2985 | EVTLKESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIGSSGTTYSFDYWGQGTMVTVSS |
| CL-29679 | 2986 | EVTLRESGPALVKPTQTLTLTCTFSGFSLSTYGMGVGWIRQPPGK<br>ALEWLANIWWDDDKYYNTSLKNRLTISKDTSKNQVVLTMTNMDPV<br>DTATYYCARIDSFGAIYSFDYWGQGTMVTVSS |
| CL-29680 | 2987 | EVTLRESGPALVKPTQTLTLTCTFSGFSLSTYGMGVGWIRQPPGK<br>ELEWLANIWWDDDKYYNPSLKNRLTISKDTSKNQVVLTMTNMDPV<br>ETATYYCARIESIGTAYNFDYWGQGTMVTVSS |
| CL-29683 | 2988 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGTSYSFDYWGQGTMFTVSS |
| CL-29688 | 2989 | EVTLRESGPALVKPTQTLTLTCTFSGFSLSTSGMGVGWIRQPPGK<br>ALEWLANIWWDDDKYYNPSLKNRLTISKDTSKNQVVLTMTNMDPV<br>DTATYYCARIESLGTSYSFDYWGQGTMVTVSS |
| CL-29689 | 2990 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIEAKGTTYSFDYWGQGTMVTVSS |
| CL-29699 | 2991 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRGTSYSFDYWGQGTMVTVSS |
| CL-29706 | 2992 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGPTYSFDYWGQGTMVTVSS |
| CL-29707 | 2993 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIETSYSFDYWGQGTMVTVSS |
| CL-29709 | 2994 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYRARIESLGTTYSFDYWGQGTMVTVSS |
| CL-29711 | 2995 | EVTLRESGPALVKPTQTLTLTCTFSGFSLSTYGMGVGWIRHPPGK<br>ALEWLANIWWDDDKYYNPSLKNRLTISKDTSKNQVVLTMTNMDPV<br>DTATYYCARIESMGTSYSFDYWGQGTMVTVSS |
| CL-29713 | 2996 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGTTYSFDYWGQGTMVTVSS |
| CL-29714 | 2997 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCALIESSGTTYSFDYWGQGTMVTVSS |
| CL-29720 | 2998 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESKGVSYSFDYWGQGTMVTVSS |
| CL-29721 | 2999 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIPTTYSFDYWGQGTMVTVSS |
| CL-29727 | 3000 | EVTLRESXPALVKPTQTLTLTCTFSGFSLSTYGMGVGWIRQPPGK<br>ELEWLANIWWDDDKYYNPSLKNRLTISKDTSKNQVVLTMTNMDPV<br>DTATYYCARIESLGTTYSFDYWGQGTMVTVSS |
| CL-29728 | 3001 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGITYSFDYWGQGTMVTVSS |
| CL-29730 | 3002 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGRSYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-29731 | 3003 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIATSYSFDYWGQGTMVTVSS |
| CL-29732 | 3004 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYNFDYWGQGTMVTVSS |
| CL-29735 | 3005 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGPMYSFDYWGQGTMVTVSS |
| CL-29736 | 3006 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTAYSFDYWGQGTMVTVSS |
| CL-29738 | 3007 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARMESSWTTYSFDYWGQGTMVTVSS |
| CL-29739 | 3008 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTGATYSFDYWGQGTMVTVSS |
| CL-29740 | 3009 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGPKYSFDYWGQGTMVTVSS |
| CL-29742 | 3010 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMGMSYSFDYWGQGTMVTVSS |
| CL-29744 | 3011 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGLSYSFDYWGQGTMVTVSS |
| CL-29745 | 3012 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYRARIESLGMSYSFDYWGQGTMVTVSS |
| CL-29746 | 3013 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARLXSTGTNYSFDYWGQGTMVTVSS |
| CL-29748 | 3014 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSDTIYSFDYWGQGTMVTVSS |
| CL-29749 | 3015 | EVTLRESGPALVKPTQTLTLTCTFSGFSLSTSGMGVDWIRQPPGK<br>ALEWLALIDWDDDIHYNPSLKNRLTISKDTSKNQVVLTMTNMDPV<br>DTATYYCARIESIGTTYSFDYWGQGTMVTVSS |
| CL-29751 | 3016 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVGTTYSFDYWGQGTMVTVSS |
| CL-29753 | 3017 | EVTLRESGPALVKPTQTLTLTCTFSGFSLSTYGMGVGWIRQPPGK<br>ALEWLANIWWYDDKYYNPSLKNRLTISKDTSKNQVVLTMTNMDPV<br>DTATYYCARIESTGTTYSFDYWGQGTMVTVSS |
| CL-29756 | 3018 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARNESFGRMYXFDYWGQGTMVTVSS |
| CL-29757 | 3019 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARXESIGTTYSFDYWGQGTMVTVSS |
| CL-29758 | 3020 | EVTLRESGPSLVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESFGTTYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-29759 | 3021 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETLGTAYSFDYWGQGTMVTVSS |
| CL-29761 | 3022 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESFGSSYSFDYWGQGTMVTVSS |
| CL-29763 | 3023 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESGPTTYSFDYWGQGTMVTVSS |
| CL-29765 | 3024 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTMYSFDYWGQGTMVTVSS |
| CL-29771 | 3025 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTXTTYSXDYWGQGTMVTVSS |
| CL-29772 | 3026 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGITYSFDYWGQGTMVTVSS |
| CL-29773 | 3027 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESMETTYSFDYWGQGTMVTVSS |
| CL-29776 | 3028 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNAITYSFDYWGQGTMVTVSS |
| CL-29777 | 3029 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSETTYMFDYWGQGTMVTVSS |
| CL-29780 | 3030 | EVTLRESGPALVKPTQTLTLTCTFSGFSLSTYGMGVGWIRQPPGK<br>ALEWLTNIWWDDDKYYNPSLKNRLTISKDTSKNQVVLTMTNMDPV<br>DTATYYCARIESMGTSYSFDYWGQGTMVTVSS |
| CL-29786 | 3031 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIYSIGTSYSFDYWGQGTMVTVSS |
| CL-33292 | 3032 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPWTYSFDYWGQGTMVTVSS |
| CL-33332 | 3033 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRPDTYSFDYWGQGTMVTVSS |
| CL-33361 | 3034 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSSASNYEFDYWGQGTMVTVSS |
| CL-33368 | 3035 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSGWTNXEFDYWGQGTMVTVSS |
| CL-33583 | 3036 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSIWTRYDFDYWGQGTMVTVSS |
| CL-33588 | 3037 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSFATNYEFDYWGQGTMVTVSS |
| CL-33591 | 3038 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVPWSYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-33592 | 3039 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTPFSYSFDYWGQGTMVTVSS |
| CL-33599 | 3040 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYDFDYWGQGTMVTVSS |
| CL-33601 | 3041 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSSTNYEFDYWGQGTMVTVSS |
| CL-33612 | 3042 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSSWRRYEFDYWGQGTMVTVSS |
| CL-33616 | 3043 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIKTSATNYDFDYWGQGTMVTVSS |
| CL-33618 | 3044 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSAFSYNFDYWGQGTMVTVSS |
| CL-33626 | 3045 | EVTLRESGPALVKPTQTLTLTCTFSGFSLSTYGMGVGWIRQPPGK<br>ALEWLANIWWDDDKYYNPSLKNRLTISKDTSKNQVFLTMTNMDPV<br>DTATYYCARIVSSLTEYNFDYWGQGTMVTVSS |
| CL-33627 | 3046 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRVDSYSFDYWGQGTMVTVSS |
| CL-33628 | 3047 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTWTSYDFDYWGQGTMVTVSS |
| CL-33654 | 3048 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVAWRYDFDYWGQGTMVTVSS |
| CL-33657 | 3049 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPTSYNFDYWGQGTMVTVSS |
| CL-33663 | 3050 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPFTYSFDYWGQGTMVTVSS |
| CL-33665 | 3051 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESDYTKYDFDYWGQGTMVTVSS |
| CL-33667 | 3052 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPTRYDFDYWGQGTMVTVSS |
| CL-33674 | 3053 | EVTLRESGPALVKPTQTLTLTCTFSGFSLSTYGMGVGWIRQPPGK<br>ALEWMANIWWDDDKYYNPSLKNRLTISKDTSKNQVVLTMTNMDPV<br>DTATYYCARIESIPTSYSFDYWGQGTMVTVSS |
| CL-33679 | 3054 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESKPTSYSFDYWGQGTMVTVSS |
| CL-33680 | 3055 | EVTLRESGPALVKPTQTLTLTCTFSGFSLSTSGMGVGWIRQPPGK<br>ALEWLANIWWDDDKYYNPSLKNRLTISKDTSKNQVVLTMTNMDPV<br>DTATYYCARIESSWTTYSFDYWGQGTMVTVSS |
| CL-33687 | 3056 | EVTLRESGPALVKPTQTLTLTCTFSGFSLSTYGMGVGWIRQPPGK<br>ALEWLANIWWDDDKYYNPSLKTRLTISKDTSKNQVVLTMTNMDPV<br>DTATYYCARIESIGTSYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-33688 | 3057 | EVTLRESGPALVKPTQTLTLTCTFSGFSLSTYGMGVGWIRQPPGK<br>ALEWLANIWWDDDKYYNPSLKNRLTISKDTFKNQVVLTMTNMDPV<br>DTATYYCARIESIPTSYSFDYWGQGTMVTVSS |
| CL-33690 | 3058 | EVTLRESGPALVKPTQTLTLTCTFSGFSLSTYGMGVGWIRQPPGK<br>ALEWLANIWWDDETYYNPSLKNRLTISKDTSKNQVVLTMTNMDPV<br>DTATYYCARIESDFTSYMFDYWGQGTMVTVSS |
| CL-33693 | 3059 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNWWSYSFDYWGQGTMVTVSS |
| CL-33696 | 3060 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSFTTYSFDYWGQGTMVTVSS |
| CL-33698 | 3061 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESXGXSYSFDYWGQGTMVTVSS |
| CL-33705 | 3062 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRLDTYSFDYWGQGTMVTVSS |
| CL-33707 | 3063 | EVTLRESGPALVKPTQTLTLTCTFSGFSLDTYGMGVGWIRQPPGK<br>ALEWLANIWWDDDKYYNPSLKNRLTISKDTSKNQVVLTMTNMDPV<br>DTATYYCARIESIGTSYSFDYWGQGTMVTVSS |
| CL-33709 | 3064 | EVTLRESGPALVKPTQTLTLTCTFSGFSLATSGMGVGWIRQPPGK<br>ALEWLANIWWDDDKYYNPSLKNRLTISKDTSKNQVVLTMTNMDPV<br>DTATYYCARIESIPWSYSFDYWGQGTMVTVSS |
| CL-33711 | 3065 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTGYSYSFDYWGQGTMVTVSS |
| CL-33712 | 3066 | EVTLRESGPALVKPTQTLTLTCTFSGFSLSTYGMGVGWIRKPPGK<br>ALEWLANIWWDDDKYYNPSLKNRLTISKDTSKNQVVLTMTNMDPV<br>DTATYYCARIESSWTSYSFDYWGQGTMVTVSS |
| CL-33722 | 3067 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSFFSYSFDYWGQGTMVTVSS |
| CL-33725 | 3068 | EVTLRESGPALVKPTQTLTLTCTFSGFSLSTYGMGVGWIRQPPGK<br>ALEWLANIWWDDDEYYNPSLKNRLTISKDTSKNQVVLTMTNMDPV<br>DTATYYCARIESLGTSYSFDYWGQGTMVTVSS |
| CL-33734 | 3069 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPGSYDFDYWGQGTMVTVSS |
| CL-33735 | 3070 | EVTLRESGPALVKPTQTLTLTCTFSGFSLSTYGMGVGWIRQPPGK<br>ELEWLANIWWDDDKYYNPSLKNRLTISKDTSKNQVVLTMTNMDPV<br>DTATYYCARIESNPLTYSFDYWGQGTMVTVSS |
| CL-33741 | 3071 | EVTLRESGPALVKPTKTLTLTCTFSGFSLSTYGMGVGWIRQPPGK<br>ALEWLANIWWDDDKYYNPSLKNRLTISKDTSKNQVVLTMTNMDPV<br>DTATYYCARIESIGISYSFDYWGQGTMVTVSS |
| CL-33743 | 3072 | EVTLRESGPALVKPTQTLTLTCTFSGFSLATYGMGVGWIRQPPGK<br>ALEWLANIWWDDDKYYNPSLKNRLTISKDTSKNQVVLTMTNMDPV<br>DTATYYCARIESLPTSYSFDYWGQGTMVTVSS |
| CL-33745 | 3073 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPFAYSFDYWGQGTMVTVSS |
| CL-33746 | 3074 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWFTYAFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-33747 | 3075 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETIXPKYSFDYWGQGTMVTVSS |
| CL-33754 | 3076 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTTYAFDYWGQGTMVTVSS |
| CL-33755 | 3077 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSEWTYSFDYWGQGTMVTVSS |
| CL-33756 | 3078 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSSWTTYEFDYWGQGTMVTVSS |
| CL-33760 | 3079 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETLGSSYSFDYWGQGTMVTVSS |
| CL-33766 | 3080 | EVTLRESGPALVKPTQTLTLTCTFSGFSLSTYGMGVGWIRKPPGK<br>ALEWLANIWWDDDKYYNPSLKNRLTISKDTSKNQVVLTMTNMDPV<br>DTATYYCARIESSFTSYSFDYWGQGTMVTVSS |
| CL-33770 | 3081 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESGGISYSFDYWGQGTMVTVSS |
| CL-33773 | 3082 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPTTYSFDYWGQGTMVTVSS |
| CL-33777 | 3083 | EVTLRESGPALVKPTQTLTLTCTFSGFSLYTYGMGVGWIRQPPGK<br>ALEWLANIWWDDDKYYNPSLKNRLTISKDTSKNQVVLTMTNMDPV<br>DTATYYCARIESVGTSYSFDYWGQGTMVTVSS |
| CL-33781 | 3084 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWYSYNFDYWGQGTMVTVSS |
| CL-33782 | 3085 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWRSYCFDYWGQGTMVTVSS |
| CL-33784 | 3086 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSPMSYSFDYWGQGTMVTVSS |
| CL-33789 | 3087 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPTSYCFDYWGQGTMVTVSS |
| CL-33791 | 3088 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWWTYSFDYWGQGTMVTVSS |
| CL-33794 | 3089 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESRPTSYCFDYWGQGTMVTVSS |
| CL-33795 | 3090 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVPTSYSFDYWGQGTMVTVSS |
| CL-33798 | 3091 | EVTLRESGPALVKPTQTLTLTCTFSGFSLSTSGMGVGWIRQPPGK<br>ALEWLANIWWDDDKYYNPSLKNRLTISKDTSKNQVVLTMTNMDPV<br>DTATYYCARIQSDGPMYSFDYWGQGTMVTVSS |
| CL-33802 | 3092 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESTGASYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-33813 | 3093 | EVTLRESGPALVKPTQTLTLTCTFSGFSLYTYGMGVGWIRQPPGK<br>ALEWLANIWWDDDKYYNPSLKNRLTISKDTSKNQVVLTMTNMDPV<br>DTATYYCARIESLPTSYSFDYWGQGTMVTVSS |
| CL-33814 | 3094 | EVTLRESGPALVKPTQTLTLTCTFSGFSLSTYGMGVGWIRQPPGK<br>ALEWLANIWWDDDKYYNPSLKNRLTISKDTSKNQVVLTMTNMDTV<br>DTATYYCARIESTPWSYSFDYWGQGTMVTVSS |
| CL-33816 | 3095 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYAFDYWGQGTMVTVSS |
| CL-33823 | 3096 | EVTLRESGPALVKPTQTLTLTCTFSGFSLSTYGMGVGWIRQPPGK<br>ELEWLANIWWDDDKYYNPSLNNRLTISKDTSKNQVVLTMTNMDPV<br>DTATYYCARIESSGPKYSFDYWGQGTMVTVSS |
| CL-33833 | 3097 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGWSYSFDYWGQGTMVTVSS |
| CL-33840 | 3098 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSAWTYSFDYWGQGTMVTVSS |
| CL-33842 | 3099 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESYGPKYSFDYWGQGTMVTVSS |
| CL-33844 | 3100 | EVTLRESGPALVKPTQTLTLTCTFSGFSLSTYGMGVGWIRQPPGK<br>ALEWLANIWWDDDKYYNPSLKTRLTISKDTSKNQVVLTMTNMDPV<br>DTATYYCARIETSWWKYSFDYWGQGTMVTVSS |
| CL-33847 | 3101 | EVTLRESGPALVKPTQTLTLTCTFSGFSLSTYGMGVGWIRQPPGK<br>ALEWLANIWWDDDKYYNLSLKNRLTISKDTSKNQVVLTMTNMDPV<br>DTATYYCARIESSPTSYSFDYWGQGTMVTVSS |
| CL-33849 | 3102 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSSYFTYSFDYWGQGTMVTVSS |
| CL-33858 | 3103 | EVTLRESGPALVKPTQTLTLTCTFSGFSLSTYGMGVGWIRQPPGK<br>ALEWLANIWWDDEEYYNPSLKNRLTISKDTSKNQVVLTMTNMDPV<br>DTATYYCARIESIGISYSFDYWGQGTMVTVSS |
| CL-33861 | 3104 | EVTLRESGPALVKPTQTLTLTCTFSGFSLYTSGMGVGWIRQPPGK<br>ALEWLANIWWDDDKYYNPSLKNRLTISKDTSKNQVVLTMTNMDPV<br>DTATYYCARIESSWTTYSFDYWGQGTMVTVSS |
| CL-33862 | 3105 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIPTRYDFDYWGQGTMVTVSS |
| CL-41180 | 3106 | EVTLRESGPALVKPTQTLTLTCTFSGFSLSTYGMGVGWIRQPPGK<br>ALEWLANIWWDDDKYYNPSLKNRLTISKDTSKNRVVLTMTNMDPV<br>DTATYYCARIVSDWTTYSFDYWGQGTMVTVSS |
| CL-41185 | 3107 | EVTLRESGPALVKPTQTLTLTCTFSGFSLSTYGMGVGWIRQPPGK<br>ALEWLANIWWDDDKYYNPSLKNRLTISKDTSKNQVVLTMTDMDPV<br>DTATYYCARIESSWTTYSFDYWGQGTMVTVSS |
| CL-41193 | 3108 | RXHWRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETFGPKYSFDYWGQGTMVTVSS |
| CL-41204 | 3109 | RGNTEESGPALVKPTQTLTLTCTFSGFSLSTYGMGVGWIRQPPGK<br>ALEWLANIWWDDDKYYNPSLKNRLTISKDTSKNQVVLTMTNMDPV<br>DTTTYYCARIESLPTSYSFDYWGQGTMVTVSS |
| CL-41213 | 3110 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLXTNYSFDYWGQGTMVTVSS |

TABLE 46-continued

List of amino Acid Sequences Of Affinity Matured hBDI-9E8.4 VH Variants

| Clone | SEQ ID NO: | VH |
|---|---|---|
| CL-41224 | 3111 | EVTLREGGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESHWWSYAFDYWGQGTMVTVSS |
| CL-41229 | 3112 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSFTSYSFDYWGQGTMVTEXC |
| CL-41232 | 3113 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESHWWSYAFDYWGQGTMVTVSS |
| CL-41233 | 3114 | RXHXGESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTTYSFDYWGQGTMVTVSS |
| CL-41246 | 3115 | EVTLRESGPALAKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESHWWSYAFDYWGQGTMVTVSS |
| CL-41252 | 3116 | EVTLRESGPALVKPTQTLTLTCAFSGFSLSTYGMGVGWIRQPPGK<br>ALEWLANIWWDDDKYYNPSLKNRLTISKDTSKNQVVLTMTNMDPV<br>DTATYYCARIESSWTTYSFDYWGQGTMVTVSS |
| CL-41255 | 3117 | EVTLRESGPALVEPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNPWKYSFDYWGQGTMVTVSS |
| CL-41257 | 3118 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNWRTYSFDYWGQGTMVTVSS |
| CL-41260 | 3119 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSFTSYSFDYWGQGTMVTVSS |
| CL-41261 | 3120 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESHWWSYAFDYWGQGTMVTVSI |
| CL-41262 | 3121 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIVSDWTTYSFDYWGQGTMVTVSS |
| CL-41268 | 3122 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGWSYSFDYWGQGTMVTVSS |
| CL-41269 | 3123 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLPTSYSFDYWGQGTMVTVSS |
| CL-41270 | 3124 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTTYSFDYWGQGTMVTVSS |
| CL-41272 | 3125 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESNPWKYSFDYWGQGTMVTVSS |
| CL-41273 | 3126 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETFGPKYSFDYWGQGTMVTVSS |
| CL-41276 | 3127 | EVTLRESGPALVKPTQTLTLTCTFSGFSLSTYGMGIGWIRQPPGK<br>ALEWLANIWWDDDKYYNPSLKNRLTISKDTSKNQVVLTMTNMDPV<br>DTATYYCARIESMGPKYAFDYWGQGTMVTVSS |
| CL-41283 | 3128 | EVTLRESGPALVKPTQTLTLTRTFSGFSLSTYGMGVGWIRQPPGK<br>ALEWLANIWWDDDKYYNPSLKNRLTISKDTSKNQVVLTMTNMDPV<br>DTATYYCARIESIPTSYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-41325 | 3129 | EVTLRESGPALVKPTQTLTLTCTFSGFSLSTYGMGVGWIRKPPGK<br>ALEWLANIWWDGDKYYNPSLKNRLTISKDTSKNQVVLTMTNMDPV<br>DTATYYCARIESSGPKYSFDYWGQGTMVTVSS |
| CL-41342 | 3130 | EVTLRESGPALVKPTQTLTLACTFSGFSLSTYGMGVGWIRQPPGK<br>ALEWLANIWWDDDKYYNPSLKNRLTISKDTSKNQVVLTMTNMDPV<br>DTATYYCARIESVWTKYYFDXGGQGTMVTVSS |
| CL-41348 | 3131 | EVTLRESGPALVKPTQTLTLTCTFSGFSLSTYEMGVGWIRQPPGK<br>ALEWLANIWWDDDKYYNPSLKNRLTISKDTPKNQVVLTMTNMDPV<br>DTATYYCARIESVWTRYDFDYWGQGTMVKXVV |
| CL-41353 | 3132 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESLGTSYSFDYWGQGTMVTVSS |
| CL-41358 | 3133 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGPKYSFDYWGQGTMVTVSS |
| CL-41361 | 3134 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESVWTRYDFDYWGQGTMVTVSS |
| CL-41362 | 3135 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETMGPKYSFDYWGQGTMVTVSS |
| CL-41365 | 3136 | RGNTRESGPALVKPTQTLTLTCTFSGFSLSTYGMGVGWIRQPPGK<br>ALKWLANIWWDDDKYYNPSLKNRLTISKDTSKNQVVLTMTNMDPV<br>DTATYYCARIESIGPKYSFDYWGQGTMVTVSS |
| CL-41366 | 3137 | EVTLRESGPAQVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIPTSYSFDYWGQGTMVTVSS |
| CL-41367 | 3138 | EVTLRESGPALVKPTQTLTLTCTFSGFSLSTYGMGVGWIRKPPGK<br>ALEWLANIWWDDDKYYNPSLKNRLTISKDTSKNQVVLTMTNMDPV<br>DTATYYCARIESSGPKYSFDYWGQGTMVTVSS |
| CL-41368 | 3139 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGPKYSFDXGGQGTMVTVSS |
| CL-41369 | 3140 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIPTSYSFDYWGQGTMVTVSS |
| CL-41376 | 3141 | EVKLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQTIGTNYSFDYWGQGTMVTVSS |
| CL-41377 | 3142 | EGQLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWGQGTMVTVSS |
| CL-41381 | 3143 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWGQSTMVTVSS |
| CL-41385 | 3144 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWGQGTIVTVSS |
| CL-41399 | 3145 | EVTLRESGPALVKPTQTLTLTCTFSGFSLSTYGMGVGWIRQPPGK<br>ALEWLANIWWDDDKYYNPSLKSRLTISKDTSKNQVVLTMTNMDPV<br>DTATYYCARIESSWTSYSFDYWGQGTMVTVSS |
| CL-41405 | 3146 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTAAYYCARIETIGPKYSFDYWGQGTMVTVSS |

TABLE 46-continued

List of amino Acid Sequences Of Affinity Matured
hBDI-9E8.4 VH Variants

| Clone | SEQ ID NO: | VH |
|---|---|---|
| CL-41411 | 3147 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSGWTNYEFDYWGQGTMVTVVV |
| CL-41420 | 3148 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSMWTRYDFDYWGQGTMVTVSS |
| CL-41425 | 3149 | RXHXRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARESSGPKYSFDYWGQGTMVTVSS |
| CL-41427 | 3150 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DAATYYCARIQSGWTNYEFDYWGQGTMVTVSS |
| CL-41436 | 3151 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWSQGTMVTVSS |
| CL-41439 | 3152 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIETIGPKYSFDYWGQGTMVTVSS |
| CL-41443 | 3153 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSGPKYSFDYWGQGTMVTVSS |
| CL-41446 | 3154 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWGQGTMVTVSS |
| CL-41447 | 3155 | EVTLRESGPALVKPTQTLTLTCTFSGFSLSTYGMGVGWIRQPPGK<br>ALEWLANIWWDDDKYYNPSLKNRLTISKDTSKNQAVLTMTNMDPV<br>DTATYYCARIQSGWTNYEFDYWGQGTMVTVSS |
| CL-41448 | 3156 | RGNTEKSGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESSWTSYSFDYWGQGTMVTVSS |
| CL-41449 | 3157 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIQSGWTNYEFDYWGQGTMVTVSS |
| CL-41452 | 3158 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMEXVVR |
| CL-41459 | 3159 | EVTLRESGPALVKPTQTLTLTCTFSGFILSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |
| CL-41463 | 3160 | EVTLRESGPALVKSTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |
| CL-41465 | 3161 | EVTLRESGPALVKPTQTLTLTCTFSGFSLSTYGMGVGWIRQPPGK<br>ALEWLANIWWDDDKYYNPSLKNRLTISKDTSKNQVVLTMTNMDPV<br>DTATYYCARIESIGTTYSFDYWGQGTMVTVSS |

Table 47 provides a list of amino acid sequences of VL regions of affinity matured humanized PDGF antibodies derived from hBDI-9E8.4. Amino acid residues of individual CDRs of each VL sequence are indicated in bold.

TABLE 47

List of Amino Acid Sequences Of Affinity Matured hBDI-9E8.4 VL Variants

| Clone | SEQ ID NO: | VL |
|---|---|---|
| CL-22656 | 3162 | EIVLTQSXGTLSLSPGXRXTLSCERSSGDIGDSYVSWYQQKPGQ APRLVIYADDQRPSGIPDRFSGSGSGTDFTLTISRLEPEDFAVY YCQSYDINIDIVFGGGTKVEIK |
| CL-22715 | 3163 | EIVLXQSPGTLSLSPGERATLSCERSSGDIGDSYVSWYQQKPGQ APRLVIYADDQRPSGIPDRFSGSGSGTDFTLTISRLEPEDFAVY YCQSYDINIDIVFGGGTKVEIK |
| CL-22747 | 3164 | EIVLTQSPGTLSLSPGERATLSCERSSGSIWYSYVSWYQQKPGQ APRLVIYADDQRPTGIPDRFSGSGSGTDFTLTISRLEPEDFAVY YCQSYDINKDLTFGGGTKVEIK |
| CL-22748 | 3165 | EIVLTQSPGTLSLSPGERATLSCERSSGSIGYSYVSWYQQKPGQ APRLVIYAADQRASGIPDRFSGSGSGTDFTLTISRLEPEDFAVY YCQQYGIIDITFGGGTKVEIK |
| CL-22749 | 3166 | EIVLTQSPGTLSLSPGERATLSCERSSGSIEHAYVSWYQQKPGQ APRLLIYGADHRATGIPDRFSGSGSGTDFTLTISRLEPEDFAVY YCQSYDFNNTITFGGGTKVEIK |
| CL-22750 | 3167 | EIVLTQSPGTLSLSPGERATLSCERSSGDIGHCYVSWYQQKPGQ APRLVIYAADHRPSGIPDRFSGSGSGTDFTLTISRLEPEDFAVY YCQQYGKNIDGTFGGGTKVEIK |
| CL-22752 | 3168 | EIVLTQSPGTLSLSPGERATLSCRASSGDIGDFCVSWYQQKPGQ APRLLIYVDDQRATGIPDRFSGSGSGTDFTLTISRLEPEDFAVY YCQSYGRRLDITFGGGTKVEIK |
| CL-22753 | 3169 | EIVLTQSPGTLSLSPGERATLSCERSSGDIVLPYVSWYQQKPGQ APRLVIYAADWRPTGIPDRFSGSGSGTDFTLTISRLEPEDFAVY YCQQYDITIDTVFGGGTKVEIK |
| CL-22754 | 3170 | EIVLTQSPGTLSLSPGERATLSCRASSGSIGYECVSWYQQKPGQ APRLVIYADDQRATGIPDRFSGSGSGTDFTLTISRLEPEDFAVY YCQSYGIDRQIVFGGGTKVEIK |
| CL-22755 | 3171 | EIVLTQSPGTLSLSPGERATLSCRASSGSIVGSYVSWYQQKPGQ APRLVIYADDQRATGIPDRFSGSGSGTDFTLTISRLEPEDFAVY YCQQYGVHIDITFGGGTKVEIK |
| CL-22756 | 3172 | EIVLTQSPGTLSLSPGERATLSCERSSGDIGHSDVSWYQQKPGQ APRLVIYADDQRASGIPDRFSGSGSGTDFTLTISRLEPEDFAVY YCQSYDINIGQVFGGGTKVEIK |
| CL-22758 | 3173 | EIVLTQSPGTLSLSPGERATLSCRASSGSIGHPYVSWYQQKPGQ APRLLIYADDQRASGIPDRFSGSGSGTDFTLTISRLEPEDFAVY YCQSYGCHIYNVFGGGTKVEIK |
| CL-22759 | 3174 | EIVLTQSPGTLSLSPGERATLSCERSSGSICDTYVSWYQQKPGQ APRLVIYADDQRASGIPDRFSGSGSGTDFTLTISRLEPEDFAVY YCQSYDIYIHIVFGGGTKVEIK |
| CL-22760 | 3175 | EIVLTQSPGTLSLSPGERATLSCERSSGDIGYSCVSWYQQKPGQ APRLVIYADDQRATGIPDRFSGSGSGTDFTLTISRLEPEDFAVY YCQQYGIDIVIVFGGGTKVEIK |
| CL-22761 | 3176 | EIVLTQSPGTLSLSPGERATLSCERSSGSIGYSDVSWYQQKPGQ APRLLIYADDKRATGIPDRFSGSGSGTDFTLTISRLEPEDFAVY YCQSYGIDKYIVFGGGTKVEIK |
| CL-22763 | 3177 | EIVLTQSPGTLSLSPGERATLSCERSSGDIWHFYVSWYQQKPGQ APRLVIYAADHRPTGIPDRFSGSGSGTDFTLTISRLEPEDFAVY YCQQYGTNIEIVFGGGTKVEIK |
| CL-22764 | 3178 | EIVLTQSPGTLSLSPGERATLSCERSSGDIGXADVSWYQQKPGQ APRLVIYVDDQRPSGIPDRFSGSGSGTDFTLTISRLEPEDFAVY YCQSYGEYIDRTFGGGTKVEIK |
| CL-22765 | 3179 | EIVLTQSPGTLSLSPGERATLSCRASSGSIGGSYVSWYQQKPGQ APRLLIYADDHRATGIPDRFSGSGSGTDFTLTISRLEPEDFAVY YCQQYGINIGTVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-22766 | 3180 | EIVLTQSPGTLSLSPGERATLSCERSSGDIECDFVSWYQQKPGQ APRLVIYADDHRASGIPDRFSGSGSGTDFTLTISRLEPEDFAVY YCQQYGINNDITFGGGTKVEIK |
| CL-22767 | 3181 | EIVLTQSPGTLSLSPGERATLSCERSSGDIGCSYVSWYQQKPGQ APRLVIYGDDQRPTGIPDRFSGSGSGTDFTLTISRLEPEDFAVY YCQSYGINKEITFGGGTKVEIK |
| CL-22768 | 3182 | EIVLTQSPGTLSLSPGERATLSCERSSGSIGHSRVSWYQQKPGQ APRLVIYVDDQRASGIPDRFSGSGSGTDFTLTISRLEPEDFAVY YCQSYDNNIATVFGGGTKVEIK |
| CL-22769 | 3183 | EIVLTQSPGTLSLSPGERATLSCERSSGSINHCHVSWYQQKPGQ APRLVIYAADXRASGIPDRFSGSGSGTDFTLTISRLEPEDFAVY YCQSYGIILDITFGGGTKVEIK |
| CL-22770 | 3184 | EIVLTQSPGTLSLSPGERATLSCERSSGDIGDSYVSWYQQKPGQ APRLVIYADDHRPTGIPDRFSGSGSGTDFTLTISRLEPEDFAVY YCQQYDFDIDITFGGGTKVEIK |
| CL-22771 | 3185 | EIVLTQSPGTLSLSPGERATLSCRASSGSIRYTYVSWYQQKPGQ APRLVIYAADEPPSGIPDRFSGSGSGTDFTLTISRLEPEDFAVY YCQSYDINRNIVFGGGTKVEIK |
| CL-22772 | 3186 | EIVLTQSPGTLSLSPGERATLSCERSSGDIGCTYVSWYQQKPGQ APRLVIYADDQRASGIPDRFSGSGSGTDFTLTISRLEPEDFAVY YCQSYGISTVLVFGGGTKVEIK |
| CL-22773 | 3187 | EIVLTQSPGTLSLSPGERATLSCERSSGDIRYCYVSWYQQKPGQ APRLLIYADDQRASGIPDRFSGSGSGTDFTLTISRLEPEDFAVY YCQSYDIDVDIVFGGGTKVEIK |
| CL-22774 | 3188 | EIVLTQSPGTLSLSPGERATLSCRASSGSISQSYVSWYQQKPGQ APRLVIYADDLRATGIPDRFSGSGSGTDFTLTISRLEPEDFAVY YCQQYGINIDITFGGGTKVEIK |
| CL-22775 | 3189 | EIVLTQSPGTLSLSPGERATLSCERSSGSIFYGCVSWYQQKPGQ APRLLIYADDQRPTGIPDRFSGSGSGTDFTLTISRLEPEDFAVY YCQQYDINIVITFGGGTKVEIK |
| CL-22776 | 3190 | EIVLTQSPGTLSLSPGERATLSCRASSGSIWYSYVSWYQQKPGQ APRLVIYAADQRATGIPDRFSGSGSGTDFTLTISRLEPEDFAVY YCQSYDINKYAVFGGGTKVEIK |
| CL-22777 | 3191 | EIVLTQSPGTLSLSPGERATLSCRASSGDISYSYVSWYQQKPGQ APRLVIYVDDERASGIPDRFSGSGSGTDFTLTISRLEPEDFAVY YCQQYDIYKDLTFGGGTKVEIK |
| CL-22778 | 3192 | EIVLTQSPGTLSLSPGERATLSCERSSGDIGDSYVSWYQQKPGQ APRLVIYADDXRPTGIPDRFSGSGSGTDFTLTISRLEPEDFAVY YCQQYDSNIDIVFGGGTKVEIK |
| CL-22779 | 3193 | EIVLTQSPGTLSLSPGERATLSCERSSGSICYXYVSWYQQKPGQ APRLLIYADDQRASGIPDRFSGSGSGTDFTLTISRLEPEDFAVY YCQQYDVNLEHTFGGGTKVEIK |
| CL-22780 | 3194 | EIVLTQSPGTLSLSPGERATLSCRASSGDIRHCYVSWYQQKPGQ APRLLIYPDDLRPSGIPDRFSGSGSGTDFTLTISRLEPEDFAVY YCQSYDINIDIVFGGGTKVEIK |
| CL-22781 | 3195 | EIVLTQSPGTLSLSPGERATLSCERSSGDIGDSYVSWYQQKPGQ APRLVIYVDDHRATGIPDRFSGSGSGTDFTLTISRLEPEDFAVY YCQQYGTSLDNTFGGGTKVEIK |
| CL-22782 | 3196 | EIVLTQSPGTLSLSPGERATLSCERSSGDIGHSYVSWYQQKPGQ APRLVIYAADHRPTGIPDRFSGSGSGTDFTLTISRLEPEDFAVY YCQQYGVNIYITFGGGTKVEIK |
| CL-22783 | 3197 | EIVLTQSPGTLSLSPGERATLSCRASSGSIRYSYVSWYQQKPGQ APRLVIYADDQRATGIPDRFSGSGSGTDFTLTISRLEPEDFAVY YCQQYDINKVIVFGGGTKVEIK |
| CL-22784 | 3198 | EIVLTQSPGTLSLSPGERATLSCERSSGDIGKPTSPWYQQKPGQ APRLVIYSADERPSGIPDRFSGSGSGTDFTLTISRLEPEDFAVY YCQQYGVNRDIVFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-22785 | 3199 | EIVLTQSPGTLSLSPGERATLSCERSSGSIGPCYVSWYQQKPGQ APRLVIYADDHRASGIPDRFSGSGSGTDFTLTISRLEPEDFAVY YCQQYDINLVITFGGGTKVEIK |
| CL-22786 | 3200 | EIVLTQSPGTLSLSPGERATLSCERSSGSIHYSYVSWYQQKPGQ APRLVIYADDQRPSGIPDRFSGSGSGTDFTLTISRLEPEDFAVY YCQSYGISIDITFGGGTKVEIK |
| CL-22787 | 3201 | EIVLTQSPGTLSLSPGERATLSCERSSGDIGDPYVSWYQQKPGQ APRLVIYAADPRASGIPDRFSGSGSGTDFTLTISRLEPEDFAVY YCQQYDISIYIVFGGGTKVEIK |
| CL-22788 | 3202 | EIVLTQSPGTLSLSPGERATLSCERSSGDIKHCCVSWYQQKPGQ APRLVIYLDDQRPSGIPDRFSGSGSGTDFTLTISRLEPEDFAVY YCQQYDISIDITFGGGTKVEIK |
| CL-22789 | 3203 | EIVLTQSPGTLSLSPGERATLSCRASSGSIVQSYVSWYQQKPGQ APRLLIYSDDPRASGIPDRFSGSGSGTDFTLTISRLEPEDFAVY YCQSYGLYRDITFGGGTKVEIK |
| CL-22790 | 3204 | EIVLTQSPGTLSLSPGERATLSCRASSGSISYSYVSWYQQKPGQ APRLLIYADDXRASGIPDRFSGSGSGTDFTLTISRLEPEDFAVY YCQHYDIHINITFGGGTKVEIK |
| CL-22791 | 3205 | EIVLTQSPGTLSLSPGERATLSCRASSGDIGYAHVSWYQQKPGQ APRLLIYGDDQRASGIPDRFSGSGSGTDFTLTISRLEPEDFAVY YCQSYGKNSEITFGGGTKVEIK |
| CL-22792 | 3206 | EIVLTQSPGTLSLSPGERATLSCRASSGSIGHSYVSWYQQKPGQ APRLLIYDDDPRPSGIPDRFSGSGSGTDFTLTISRLEPEDFAVY YCQQYGINVDIVFGGGTKVEIK |
| CL-22794 | 3207 | EIVLTQSPGTLSLSPGERATLSCRASSGSIGHSCVSWYQQKPGQ APRLVIYSADERASGIPDRFSGSGSGTDFTLTISRLEPEDFAVY YCQQYDLNTLFVFGGGTKVEIK |
| CL-22795 | 3208 | EIVLTQSPGTLSLSPGERATLSCRASSGDIGHXYVSWYQQKPGQ APRLVIYAADHRPSGIPDRFSGSGSGTDFTLTISRLEPEDFAVY YCQQYGISIAVVFGGGTKVEIK |
| CL-22796 | 3209 | EIVLTQSPGTLSLSPGERATLSCERSSGSIGLSYVSWYQQKPGQ APRLVIYAADQRPSGIPDRFSGSGSGTDFTLTISRLEPEDFAVY YCQQYDRHLDATFGGGTKVEIK |
| CL-22797 | 3210 | EIVLTQSPGTLSLSPGERATLSCERSSGDIGCSYVSWYQQKPGQ APRLLIYGADHRASGIPDRFSGSGSGTDFTLTISRLEPEDFAVY YCQQYGIDIDITFGGGTKVEIK |
| CL-22798 | 3211 | EIVLTQSPGTLSLSPGERATLSCERSSGDIGDASVSWYQQKPGQ APRLLIYAADQRASGIPDRFSGSGSGTDFTLTISRLEPEDFAVY YCQSYDITIGVVFGGGTKVEIK |
| CL-22799 | 3212 | EIVLTQSPGTLSLSPGERATLSCERSSGDIGYCFVSWYQQKPGQ APRLVIYAADLRASGIPDRFSGSGSGTDFTLTISRLEPEDFAVY YCQSYGIKIGITFGGGTKVEIK |
| CL-22800 | 3213 | EIVLTQSPGTLSLSPGERATLSCERSSGDIGYWDVSWYQQKPGQ APRLLIYADDERASGIPDRFSGSGSGTDFTLTISRLEPEDFSVY YCQSYGINKDFVFGGGTKVEIK |
| CL-22801 | 3214 | EIVLTQSPGTLSLSPGERATLSCRASSGDIGHTYVSWYQQKPGQ APRLVIYTDDLRASGIPDRFSGSGSGTDFTLTISRLDPEDFAVY YCQQYDLNIDIVFGGGTKVEIK |
| CL-22802 | 3215 | EIVLTQSPGTLSLSPGERATLSCERSSGSIGXSHVSWYQQKPGQ APRLLIYVDDQRPSGIPDRFSGSGSGTDFTLTISRLEPEDFAVY YCQSYGIKKGXTFGGGTKVEIK |
| CL-22803 | 3216 | EIVLTQSPGTLSLSPGERATLSCRASSGDIGHSFVSWYQQKPGQ APRLVIYADDHRASGIPDRFSGSGSGTDFTLTISRLEPEDFAVY YCQSYGVNIDITFGGGTKVEIK |

TABLE 47-continued

List of Amino Acid Sequences Of Affinity Matured hBDI-9E8.4 VL Variants

| Clone | SEQ ID NO: | VL |
|---|---|---|
| CL-22804 | 3217 | EIVLTQSPGTLSLSPGERATLSCRASSGSIFQSDVSWYQQKPGQAPRLVIYADDHRPSGIPDRFSGSGSGTDFTLTISRLEPEDFAVYYCQQYGKNIYIVFGGGTKVEIK |
| CL-22805 | 3218 | EIVLTQSPGTLSLSPGERATLSCRASSGDIGYSAVSWYQQKPGQAPRLVXYVDDQRATGIPDRFSGSGSGTDFTLTISRLEPEDFAVYYCQSYGIKLDFVFGGGTKVEIK |
| CL-22806 | 3219 | EIVLTQSPGTLSLSPGERATLSCRASSGSIVYSSVSWYQQKPGQAPRLVIYVXDQRASGIPDRFSGSGSGTDFTLTISRLEPEDFAVYYCQQYDIHIDITFGGGTKVEIK |
| CL-22807 | 3220 | EIVLTQSPGTLSLSPGERATLSCRASSGSIRDFYVSWYQQKPGQAPRLVIYADDQRASGIPDRFSGSGSGTDFTLTISRLEPEDFAVYYCQQYGINLDNTFGGGTKVEIK |
| CL-22808 | 3221 | EIVLTQSPGTLSLSPGERATLSCERSSGDISDSHVSWYQQKPGQAPRLVIYADDQRPSGIPDRFSGSGSGTDFTLTISRLEPEDFAVYYCQSYDINIDITFGGGTKVEIK |
| CL-22811 | 3222 | EIVLTQSPGTLSLSPGERATLSCERSSGSIALSYVSWYQQKPGQAPRLVIYADDQRPSGIPDRFSGSGSGTDFTLTISRLEPEDFAVYYCQSYGINLDIVFGGGTKVEIK |
| CL-22812 | 3223 | EIVLTQSPGTLSLSPGERATLSCERSSGDMRYSDVSWYQQKPGQAPRMVIYAVDQRASGIPDRLSGSGSGTDFTLTISRLEPEDFAVYYCQQYDVGMVLTFGGGTKVEIK |
| CL-22813 | 3224 | EIVLTQSPGTLSLSPGERATLSCRASSGDIGHFYVSWYQQKPGQAPRLLIYADDQRASGIPDRFSGSGSGTDFTLTISRLEPEDFAVYYCQSYGISIDLTFGGGTKVEIK |
| CL-22815 | 3225 | EIVLTQSPGTLSLSPGERATLSCERSSGDIDHSYVSWYQQKPGQAPRLVIYADDPRATGIPDRFSGSGSGTDFTLTISRLEPEDFAVYYCQSYGLNIDLTFGGGTKVEIK |
| CL-22816 | 3226 | EIVLTQSPGTLSLSPGERATLSCERSSGSIRHSCVSWYQQKPGQAPRLVIYADDHRASGIPDRFSDSGSGTDFTLTISRLEPEDFAVYYCQSYDINIDIVFGGGTKVEIK |
| CL-22818 | 3227 | EIVLTQSPGTLSLSPGERATLSCRASSGDIWHSYVSWYQQKPGQAPRLVIYTDDHRASGIPDRFSGSGSGTDFTLTISRLEPEDFAVYYCQQYGCDKDITFGGGTKVEIK |
| CL-22819 | 3228 | EIVLTQSPGTLSLSPGERATLSCRASSGSIGDFYVSWYQQKPGQAPRLVIYADDQRPTGIPDRLSGSGSGTDFTLTISRLEPEDFAVYYCQQYGIHIEIVFGGGTKVEIK |
| CL-22820 | 3229 | EIVLTQSPGTLSLSPGERATLSCRASSGDIGHSAVSWYQQKPGQAPRLLIYADDPRATGIPDRFSGSGSGTDFTLTISRLEPEDFAVYYCQQYGKNKELVFGGGTKVEIK |
| CL-22821 | 3230 | EIVLTQSPGTLSLSPGERATLSCERSSGDIGYSYVSWYQQKPGQAPRLVIYADDQRASGIPDRFSGSGSGTDFTLTISRLEPEDFAVYYCQQYGINSYLVFGGGTKVEIK |
| CL-22822 | 3231 | EIVLTQSPGTLSLSPGERATLSCRASSGDIGPSYVSWYQQKPGQAPRLLIYPDDQRATGIPDRFSGSGSGTDFTLTISRLEPEDFAVYYCQQYDINKELVFGGGTKVEIK |
| CL-22823 | 3232 | EIVLTQSPGTLSLSPGERATLSCERSSGDIWYSYVSWYQQKPGQAPRLVIYADDQRATGIPDRFSGSGSGTDFTLTISRLEPEDFAVYYCQQYGKNVDIVFGGGTKVEIK |
| CL-22824 | 3233 | EIVLTQSPGTLSLSPGERATLSCRASSGSILDTYVSWYQQKPGQAPRLVIYADDSRATGIPDRFSGSGSGTDFTLTISRLEPEDFAVYYCQQYDVNVDIVFGGGTKVEIK |
| CL-22825 | 3234 | EIVLTQSPGTLSLSPGERATLSCRASSGSISQSYVSWYQQKPGQAPRLVIYADDQRASGIPDRFSGSGSGTDFTLTISRLEPEDFAVYYCQSYDXTIGIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-22826 | 3235 | EIVLTQSPGTLSLSPGERATLSCERSSGSIGFSYVSWYQQKPGQ APRLVIYEDDPRPSGIPDRFSGSGSGTDFTLTISRLEPEDFAVY YCQQYGANIEIVFGGGTKVEIK |
| CL-22827 | 3236 | EIVLTQSPGTLSLSPGERATLSCRASSGYISHEYVSWYQQKPGQ APRLVIYAADQRPSGIPDRFSGSGSGTDFTLTISRLEPEDFAVY YCQQYGIHIHVTFGGGTKVEIK |
| CL-22828 | 3237 | EIVLTQSPGTLSLSPGERATLSCRASSGDIGHSYVSWYQQKPGQ APRLVIYEDDQRPTGIPDRFSGSGSGTDFTLTISRLEPEDFAVY YCQSYGGNIGIVFGGGTKVEIK |
| CL-22829 | 3238 | EIVLTQSPGTLSLSPGERATLSCRASSGSIDASYVSWYQQKPGQ APRLLIYTDDRRASGIPDRFSGSGSGTDFTLTISRLEPEDFAVY YCQQYGIILDIVFGGGTKVEIK |
| CL-22830 | 3239 | EIVLTQSPGTLSLSPGERATLSCRASSGSIGYSYVSWYQQKPGQ APRLLIYADDHRPSGIPDRFSGSGSGTDFTLTISRLEPEDFAVY YCQQYGVIIYITFGGGTKVEIK |
| CL-22832 | 3240 | EIVLTQSPGTLSLSPGERATLSCRASSGDIFYSYVSWYQQKPGQ APRLVIYADDXRASGIPDRFSGSGSGTDFTLTISRLEPEDFAVY YCQSYDINIDIVFGGGTKVEIK |
| CL-22833 | 3241 | EIVLTQSPGTLSLSPGERATLSCERSSGDIGYLYVSWYQQKPGQ APXLVIYPDDXRASGIPDRFSGSGSGXDFTLTISRLEPEDXAVY YCQQYDKTIDIVFGGGTKVEIK |
| CL-22834 | 3242 | EIVLTQSPGTLSLSPGERATLSCRASSGDICESCVSWYQQKPGQ APRLVIYADDQRASGIPDRFSGSGSGTDFTLTISRLEPEDFAVY YCQSYGINKDIVFGGGTKVEIK |
| CL-22835 | 3243 | EIVLTQSPGTLSLSPGERATLSCERSSGDIGYSNVSWYQQKPGQ APRLLIYEDDKRASGIPDRFSGSGSGTDFTLTISRLEPEDFAVY YCQQYGXLVPIVFGGGTKVEIK |
| CL-22836 | 3244 | EIVLTQSPGTLSLSPGERATLSCERSSGDIGHSYVSWYQQKPGQ APRLVIYADDQRATGIPDRFSGSGSGTDFTLTISRLEPEDFAVY YCQQYGIKVDSTFGGGTKVEIK |
| CL-22837 | 3245 | EIVLTQSPGTLSLSPGERATLSCERSSGSIQSLHVSWYQQKPGQ APRLLIYADDXRASGIPDRFSGSGSGTDFTLTISRLEPEDFAVY YCQSYGRHIGLVFGGGTKVEIK |
| CL-22838 | 3246 | EIVLTQSPGTLSLSPGERATLSCERSSGSIGYCYVSWYQQKPGQ APRLVIYADDHRASGIPDRFSGSGSGTDFTLTISRLEPEDFAVY YCQQYDLCIYITFGGGTKVEIK |
| CL-22839 | 3247 | EIVLTQSPGTLSLSPGERATLSCERSSGDIGDSHVSWYQQKPGQ APRLVIYADDQRASGIPDRFSGSGSGTDFTLTISRLEPEDFAVY YCQSYDINIAITFGGGTKVEIK |
| CL-22840 | 3248 | EIVLTQSPGTLSLSPGERATLSCERSSGDIGYTYVSWYQQKPGQ APRLLIYPDDKRPTGIPDRFSGSGSGTDFTLTISRLEPEDFAVY YCQSYGIIRPTTFGGGTKVEIK |
| CL-22841 | 3249 | EIVLTQSPGTLSLSPGERATLSCERSSGDIAHSYVSWYQQKPGQ APRLVIYAADYRASGIPDRFSGSGSGTDFTLTISRLEPEDFAVY YCQQYDSHNNIVFGGGTKVEIK |
| CL-22842 | 3250 | EIVLTQSPGTLSLSPGERATLSCRASSGSIRGLRVSWYQQKPGQ APRLLIYADDQRASGIPDRFSGSGSGTDFTLTISRLEPEDFAVY YCQSYGLNFDIVFGGGTKVEIK |
| CL-25631 | 3251 | EIVLTQSPGTLSLSPGERATLSCRASSGSITYYYVSWYQQKPGQ APRLLIYADDQRASGIPDRFSGSGSGTDFTLTISRLEPEDFAVY YCQSYDINTDIVFGGGTKVEIK |
| CL-25634 | 3252 | EFVLTQSPGTLSLSPGERATLSCERSSGDIGDSYVSWYQQKPGQ APRLVIYADDQRPSGIPDRFSGSGSGTDFTLTISRLEPEDFAVY YCQSYDINIDIVFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-25648 | 3253 | EIVLTQSPGTLSLSPGEXATLSCERSSGDIGDSYVSWYQQKPGQ APRLVIYVDDQRPSGIPDRFSGSGSGTDFTLTISRLEPEDFAVY YCQSYDINIDIVFGGGTKVEIK |
| CL-25655 | 3254 | EIVLTQSPGTLSLSPGERXTLSCERSSGDIGDSYVSWYQQKPGQ APRLVIYADDQRPSGIPDRFSGSGSGTDFTLTISRLEPEDFAVY YCQSYDINIDIVFGGGTKVEIK |
| CL-25666 | 3255 | EIVLTQXPGTLSLSPGERATLSCERSSGDIGDSYVSWYQQKPGQ APRLVIYADDQRPSGIPDRFSGSGSGTDFTLTISRLEPEDFAVY YCQSYDINIDIVFGGGTKVEIK |
| CL-25690 | 3256 | EIVLTQSPGTLSLSPGERATLSCERSSGDIGDSYVSWYQQKPGQ APRLVIYSDDQRPGGIPDRFSGSGSGTDFTLTISRLEPEDFAVY YCQSYDINIDIVFGGGTKVEIK |
| CL-25721 | 3257 | EIVLTQSPGTLSLSPGERATLSCERSSGDIGDSYVSWYQQKPGQ APRLVIYADDQRPSGIPDRFSGYGSGTDFTLTISRLEPEDFAVY YCQSYDINIDIVFGGGTKVEIK |
| CL-25724 | 3258 | EIVLTQSPGTLSLSPGERATLSCERSSGDIGDSYVSWYQQKPGQ APRLLIYVDDWRASGIPDRFSGSGSGTDFTLTISRLEPEDFAVY YCQSYGIDIDVVFGGGTKVEIK |
| CL-25725 | 3259 | EIVLTQSPGTLSLSPGERATLSCERSSGDIDYSYVSWYQQKPGQ APRLVIYADDQRASGIPDRFSGSGSGTDFTLTISRLEPEDFAVY YCQSYDIDIDIVFGGGTKVEIK |
| CL-25726 | 3260 | EIVLTQSPGTLSLSPGERATLSCRASSGSIGYSYVSWYQQKPGQ APRLVIYADDQRASGIPDRFSGSGSGTDFTLTISRLEPEDFAVY YCQSYDINTDVVFGGGTKVEIK |
| CL-25727 | 3261 | EIVLTQSPGTLSLSPGERATLSCERSSGDIWYSYVSWYQQKPGQ APRLVIYADDQRASGIPDRFSGSGSGTDFTLTISRLEPEDFAVY YCQSYDIYIDVTFGGGTKVEIK |
| CL-25728 | 3262 | EIVLTQSPGTLSLSPGERATLSCERSSGSIGYSYVSWYQQKPGQ APRLVIYSDDQRPSGIPDRFSGSGSGTDFTLTISRLEPEDFAVY YCQSYDIDIDIVFGGGTKVEIK |
| CL-25729 | 3263 | EIVLTQSPGTLSLSPGERATLSCERSSGDIAGYYVSWYQQKPGQ APRLVIYADDQRATGIPDRFSGSGSGTDFTLTISRLEPEDFAVY YCQSYDIIIDITFGGGTKVEIK |
| CL-25730 | 3264 | EIVLTQSPGTLSLSPGERATLSCERSSGDIGESYVSWYQQKPGQ APRLVIYADDLRASGIPDRFSGSGSGTDFTLTISRLEPEDFAVY YCQSYGIVIDIXFGGGTKVEIK |
| CL-25731 | 3265 | EIVLTQSPGTLSLSPGERATLSCRASSGSIVYSYVSWYQQKPGQ APRLVIYSDDQRASGIPDRFSGSGSGTDFTLTISRLEPEDFAVY YCQSYDIYIDITFGGGTKVEIK |
| CL-25732 | 3266 | EIVLTQSPGTLSLSPGERATLSCRASSGDIVYSYVSWYQQKPGQ APRLVIYADDQRASGIPDRFSGSGSGTDFTLTISRLEPEDFAVY YCQSYGIDIDVTFGGGTKVEIK |
| CL-25733 | 3267 | EIVLTQSPGTLSLSPGERATLSCRASSGDIWDAYVSWYQQKPGQ APRLLIYADDHRASGIPDRFSGSGSGTDFTLTISRLEPEDFAVY YCQSYDIIIDITFGGGTKVEIK |
| CL-25734 | 3268 | EIVLTQSPGTLSLSPGERATLSCERSSGDIGYAYVSWYQQKPGQ APRLVIYADDYRPTGIPDRFSGSGSGTDFTLTISRLEPEDFAVY YCQSYDIDVDIVFGGGTKVEIK |
| CL-25735 | 3269 | EIVLTQSPGTLSLSPGERATLSCRASSGDILDSYVSWYQQKPGQ APRLVIYSDDQRASGIPDRFSGSGSGTDFTLTISRLEPEDFAVY YCQSYDTIIDITFGGGTKVEIK |
| CL-25736 | 3270 | EIVLTQSPGTLSLSPGERATLSCERSSGDIDDYYVSWYQQKPGQ APRLLIYADDQRASGIPDRFSGSGSGTDFTLTISRLEPEDFAVY YCQSYDIYIDVTFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-25737 | 3271 | EIVLTQSPGTLSLSPGERATLSCERSSGDIWDFYVSWYQQKPGQ APRLVIYADDQRPSGIPDRFSGSGSGTDFTLTISRLEPEDFAVY YCQSYDVTIDVTFGGGTKVEIK |
| CL-25738 | 3272 | EIVLTQSPGTLSLSPGERATLSCERSSGDIGLSYVSWYQQKPGQ APRLVIYSDDLRASGIPDRFSGSGSGTDFTLTISRLEPEDFAVY YCQSYDVDIDVTFGGGTKVEIK |
| CL-25739 | 3273 | EIVLTQSPGTLSLSPGERATLSCERSSGDIFYTYVSWYQQKPGQ APRLVIYADDQRATGIPDRFSGSGSGTDFTLTISRLEPEDFAVY YCQSYDLDIDITFGGGTKVEIK |
| CL-25740 | 3274 | EIVLTQSPGTLSLSPGERATLSCERSSGDIGDSYVSWYQQKPGQ APRLLIYADDQRAIGIPDRFSGSGSGTDFTLTISRLEPEDFAVY YCQSYDIYVDVVFGGGTKVEIK |
| CL-25741 | 3275 | EIVLTQSPGTLSLSPGERATLSCRASSGDIEGSYVSWYQQKPGQ APRLVIYSDDLRASGIPDRFSGSGSGTDFTLTISRLEPEDFAVY YCQSYDIIIDIVFGGGTKVEIK |
| CL-25742 | 3276 | EIVLTQSPGTLSLSPGERATLSCRASSGDISCSYVSWYQQKPGQ APRLVIYADDQRATGIPDRFSGSGSGTDFTLTISRLEPEDFAVY YCQSYDINTDIVFGGGTKVEIK |
| CL-25743 | 3277 | EIVLTQSPGTLSLSPGERATLSCRASSGSIGSYVSWYQQKPGQ APRLVIYSDDQRPTGIPDRFSGSGSGTDFTLTISRLEPEDFAVY YCQSYDIYIDVVFGGGTKVEIK |
| CL-25745 | 3278 | EIVLTQSPGTLSLSPGERATLSCRASSGDIWYSYVSWYQQKPGQ APRLVIYADDQRASGIPDRFSGSGSGTDFTLTISRLEPEDFAVY YCQSYGIEIDVTFGGGTKVEIK |
| CL-25747 | 3279 | EIVLTQSPGTLSLSPGERATLSCRASSGDIGYSYVSWYQQKPGQ APRLLIYADDQRATGIPDRFSGSGSGTDFTLTISRLEPEDFAVY YCQSYDIISDITFGGGTKVEIK |
| CL-25748 | 3280 | EIVLTQSPGTLSLSPGERATLSCRASSGSIDYAYVSWYQQKPGQ APRLVIYADDQRPTGIPDRFSGSGSGTDFTLTISRLEPEDFAVY YCQSYGITIDVVFGGGTKVEIK |
| CL-25749 | 3281 | EIVLTQSPGTLSLSPGERATLSCRASSGSIYFAYVSWYQQKPGQ APRLVIYSDDQRASGIPDRFSGSGSGTDFTLTISRLEPEDFAVY YCQSYGITIDVVFGGGTKVEIK |
| CL-25751 | 3282 | EIVLTQSPGTLSLSPGERATLSCRASSGSIWYSYVSWYQQKPGQ APRLVIYADDQRATGIPDRFSGSGSGTDFTLTISRLEPEDFAVY YCQSYGINVDIVFGGGTKVEIK |
| CL-25752 | 3283 | EIVLTQSPGTLSLSPGERATLSCRASSGDIAHSYVSWYQQKPGQ APRLVIYTDDARASGIPDRFSGSGSGTDFTLTISRLEPEDFAVY YCQSYDIIVDIVFGGGTKVEIK |
| CL-25754 | 3284 | EIVLTQSPGTLSLSPGERATLSCERSSGDICQYYVSWYQQKPGQ APRLLIYADDQRASGIPDRFSGSGSGTDFTLTISRLEPEDFAVY YCQSYDLNIDVTFGGGTKVEIK |
| CL-25756 | 3285 | EIVLTQSPGTLSLSPGERATLSCERSSGSIGDSYVSWYQQKPGQ APRLLIYNDDDRPSGIPDRFSGSGSGTDFTLTISRLEPEDFAVY YCQSYDLTIDVTFGGGTKVEIK |
| CL-25758 | 3286 | EIVLTQSPGTLSLSPGERATLSCERSSGDIGYSYVSWYQQKPGQ APRLVIYADDQRPTGIPDRFSGSGSGTDFTLTISRLEPEDFAVY YCQSYDIIIDIVFGGGTKVEIK |
| CL-25759 | 3287 | EIVLTQSPGTLSLSPGERATLSCERSSGDIGHSYVSWYQQKPGQ APRLVIYADDQRPSGIPDRFSGSGSGTDFTLTISRLEPEDFAVY YCQSYDIDVDIVFGGGTKVEIK |
| CL-25760 | 3288 | EIVLTQSPGTLSLSPGERATLSCERSSGSIWDMYVSWYQQKPGQ APRLVIYADDQRPTGIPDRFSGSGSGTDFTLTISRLEPEDFAVY YCQSYDIEIDITFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-25761 | 3289 | EIVLTQSPGTLSLSPGERATLSCERSSGDIGDSYVSWYQQKPGQ APRLVIYGDDQRASGIPDRFSGSGSGTDFTLTISRLEPEDFAVY YCQSYDIIIDITFGGGTKVEIK |
| CL-25763 | 3290 | EIVLTQSPGTLSLSPGERATLSCERSSGDIWESYVSWYQQKPGQ APRLVIYADDERATGIPDRFSGSGSGTDFTLTISRLEPEDFAVY YCQSYGINIDIVFGGGTKVEIK |
| CL-25765 | 3291 | EIVLTQSPGTLSLSPGERATLSCRASSGDIAYSYVSWYQQKPGQ APRLVIYADDQRASGIPDRFSGSGSGTDFTLTISRLEPEDFAVY YCQSYDINIDIVFGGGTKVEIK |
| CL-25767 | 3292 | EIVLTQSPGTLSLSPGERATLSCRASSGSIFGAYVSWYQQKPGQ APRLVIYADDQRASGIPDRFSGSGSGTDFTLTISRLEPEDFAVY YCQSYGIITDIVFGGGTKVEIK |
| CL-25769 | 3293 | EIVLTQSPGTLSLSPGERATLSCRASSGSIADSLVSWYQQKPGQ APRLVIYTDDWRASGIPDRFSGSGSGTDFTLTISRLEPEDFAVY YCQSYGINIDVVFGGGTKVEIK |
| CL-25770 | 3294 | EIVLTQSPGTLSLSPGERATLSCERSSGSIGDSYVSWYQQKPGQ APRLLIYTDDQRASGIPDRFSGSGSGTDFTLTISRLEPEDFAVY YCQSYDITIDIVFGGGTKVEIK |
| CL-25771 | 3295 | EIVLTQSPGTLSLSPGERATLSCERSSGDIGDYYVSWYQQKPGQ APRLVIYSDDQRPTGIPDRFSGSGSGTDFTLTISRLEPEDFAVY YCQSYDLDIDITFGGGTKVEIK |
| CL-25772 | 3296 | EIVLTQSPGTLSLSPGERATLSCERSSGSIVHSYVSWYQQKPGQ APRLVXYADDQRATGIPDRFSGSGSGTDFTLTISRLEPEDFAVY YCQSYDIXVDIVFGGGTKVEIK |
| CL-25773 | 3297 | EIVLTQSPGTLSLSPGERATLSCRASSGDIWYSYVSWYQQKPGQ APRLVIYADDQRASGIPDRFSGSGSGTDFTLTISRLEPEDFAVY YCQSYGITVDIVFGGGTKVEIK |
| CL-25775 | 3298 | EIVLTQSPGTLSLSPGERATLSCERSSGDIFYSYVSWYQQKPGQ APRLVIYADDERASGIPDRFSGSGSGTDFTLTISRLEPEDFAVY YCQSYDIEIDIVFGGGTKVEIK |
| CL-25776 | 3299 | EIVLTQSPGTLSLSPGERATLSCERSSGDIGDSYVSWYQQKPGQ APRLVIYADDQRATGIPDRFSGSGSGTDFTLTISRLEPEDFAVY YCQSYDIDVDIVFGGGTKVEIK |
| CL-25778 | 3300 | EIVLTQSPGTLSLSPGERATLSCERSSGDIGLSYVSWYQQKPGQ APRLLIYADDQRASGIPDRFSGSGSGTDFTLTISRLEPEDFAVY YCQSYDLIIDIVFGGGTKVEIK |
| CL-25779 | 3301 | EIVLTQSPGTLSLSPGERATLSCERSSGDIGYSYVSWYQQKPGQ APRLVIYSDDQRPSGIPDRFSGSGSGTDFTLTISRLEPEDFAVY YCQSYDIDIDIVFGGGTKVEIK |
| CL-25780 | 3302 | EIVLTQSPGTLSLSPGERATLSCRASSGDIGYSYVSWYQQKPGQ APRLVIYADDERASGIPDRFSGSGSGTDFTLTISRLEPEDFAVY YCQSYDIEIDITFGGGTKVEIK |
| CL-25782 | 3303 | EIVLTQSPGTLSLSPGERATLSCRASSGDIGYSYVSWYQQKPGQ APRLLIYFDDYRPTGIPDRFSGSGSGTDFTLTISRLEPEDFAVY YCQSYGIEIDIVFGGGTKVEIK |
| CL-25783 | 3304 | EIVLTQSPGTLSLSPGERATLSCERSSGDIGYYYVSWYQQKPGQ APRLVIYADDERATGIPDRFSGSGSGTDFTLTISRLEPEDFAVY YCQSYDIYIDVVFGGGTKVEIK |
| CL-25784 | 3305 | EIVLTQSPGTLSLSPGERATLSCRASSGDISDSYVSWYQQKPGQ APRLVIYTDDHRPSGIPDRFSGSGSGTDFTLTISRLEPEDFAVY YCQSYGINIDIVFGGGTKVEIK |
| CL-25785 | 3306 | EIVLTQSPGTLSLSPGERATLSCERSSGSIGDSYVSWYQQKPGQ APRLVIYVDDWRASGIPDRFSGSGSGTDFTLTISRLEPEDFAVY YCQSYGIDVDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-25786 | 3307 | EIVLTQSPGTLSLSPGERATLSCERSSGDIGHSYVSWYQQKPGQ APRLVIYSDDQRPSGIPDRFSGSGSGTDFTLTISRLEPEDFAVY YCQSYDIIIDIVFGGGTKVEIK |
| CL-25787 | 3308 | EIVLTQSPGTLSLSPGERATLSCERSSGDIWYSYVSWYQQKPGQ APRLVIYADDQRATGIPDRFSGSGSGTDFTLTISRLEPEDFAVY YCQQYDIIDDIVFGGGTKVEIK |
| CL-25788 | 3309 | EIVLTQSPGTLSLSPGERATLSCRASSGDIGYSYVSWYQQKPGQ APRLLIYADDFRPTGIPDRFSGSGSGTDFTLTISRLEPEDFAVY YCQSYGIITDITFGGGTKVEIK |
| CL-25789 | 3310 | EIVLTQSPGTLSLSPGERATLSCERSSGDIYYSYVSWYQQKPGQ APRLVIYSDDQRATGIPDRFSGSGSGTDFTLTISRLEPEDFAVY YCQSYDINIDVTFGGGTKVEIK |
| CL-25790 | 3311 | EIVLTQSPGTLSLSPGERATLSCERSSGDIGYSYVSWYQQKPGL APRLLIYADDQRPSGIPDRFSGSGSGTDFTLTISRLEPEDFAVY YCQSYGTYVDIVFGGGTKVEIK |
| CL-25791 | 3312 | EIVLTQSPGTLSLSPGERATLSCERSSGDIGDTYVSWYQQKPGQ APRLVIYADDQRASGIPDRXSGSGSGTDFTLTISRLEPEDFAVY YCQSYGINIDXVFGGGTKVEIK |
| CL-25792 | 3313 | EIVLTQSPGTLSLSPGERATLSCERSSGSIWQYYVSWYQQKPGQ APRLVIYSDDQRPSGIPDRFSGSGSGTDFTLTISRLEPEDFAVY YCQSYDINIDIVFGGGTKVEIK |
| CL-25793 | 3314 | EIVLTQSPGTLSLSPGERATLSCERSSGDIGDSYVSWYQQKPGQ APRLVIYADDWRPTGIPDRFSGSGSGTDFTLTISRLEPEDFAVY YCQSYDIYIDIVFGGGTKVEIK |
| CL-25794 | 3315 | EIVLTQSPGTLSLSPGERATLSCERSSGDIGHSYVSWYQQKPGQ APRLVIYADDQRASGIPDRFSGSGSGTDFTLTISRLEPEDFAVY YCQSYDTIIDIVFGGGTKVEIK |
| CL-25795 | 3316 | EIVLTQSPGTLSLSPGERATLSCERSSGDIGDYYVSWYQQKPGQ APRLLIYADDQRASGIPDRFSGSGSGTDFTLTISRLEPEDFAVY YCQSYDIDIDVVFGGGTKVEIK |
| CL-25796 | 3317 | EIVLTQSPGTLSLSPGERATLSCERSSGDIGDSYVSWYQQKPGQ APRLVIYADDQRASGIPDRFSGSGSGTDFTLTISRLEPEDFAVY YCQSYDTIIDIVFGGGTKVEIK |
| CL-25797 | 3318 | EIVLTQSPGTLSLSPGERATLSCERSSGDIWQYYVSWYQQKPGQ APRLVIYADDQRASGIPDRFSGSGSGTDFTLTISRLEPEDFAVY YCQSYDLNIDITFGGGTKVEIK |
| CL-25798 | 3319 | EIVLTQSPGTLSLSPGERATLSCRASSGDIGESYVSWYQQKPGQ APRLVIYSDDSRASGIPDRFSGSGSGTDFTLTISRLEPEDFAVY YCQSYDIIIDIVFGGGTKVEIK |
| CL-25799 | 3320 | EIVLTQSPGTLSLSPGERATLSCRASSGDIGYSYVSWYQQKPGQ APRLVIYADDLRPTGIPDRFSGSGSGTDFTLTISRLEPEDFAVY YCQSYGIIIDIVFGGGTKVEIK |
| CL-25800 | 3321 | EIVLTQSPGTLSLSPGERATLSCERSSGDIGDYYVSWYQQKPGQ APRLVIYWDDYRPSGIPDRFSGSGSGTDFTLTISRLEPEDFAVY YCQSYDVILDITFGGGTKVEIK |
| CL-25801 | 3322 | EIVLTQSPGTLSLSPGERATLSCERSSGDISYTYVSWYQQKPGQ APRLVIYSDDQRASGIPDRFSGSGSGTDFTLTISRLEPEDFAVY YCQSYGIITDIVFGGGTKVEIK |
| CL-25802 | 3323 | EIVLTQSPGTLSLSPGERATLSCERSSGDIGESYVSWYQQKPGQ APRLVIYTDDWRASGIPDRFSGSGSGTDFTLTISRLEPEDFAVY YCQSYGSNIDVVFGGGTKVEIK |
| CL-25803 | 3324 | EIVLTQSPGTLSLSPGERATLSCERSSGDIWDYYVSWYQQKPGQ APRLVIYADDQRATGIPDRFSGSGSGTDFTLTISRLEPEDFAVY YCQSYGILTDITFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-25804 | 3325 | EIVLTQSPGTLSLSPGERATLSCRASSGSIAHSYVSWYQQKPGQ<br>APRLVIYSDDQRPSGIPDRFSGSGSGTDFTLTISRLEPEDFAVY<br>YCQSYDIIVDIVFGGGTKVEIK |
| CL-25805 | 3326 | EIVLTQSPGTLSLSPGERATLSCRASSGSIVYSYVSWYQQKPGQ<br>APRLVIYADDQRASGIPDRFSGSGSGTDFTLTISRLEPEDFAVY<br>YCQSYGIITDIVFGGGTKVEIK |
| CL-25806 | 3327 | EIVLTQSPGTLSLSPGERATLSCERSSGDISYSYVSWYQQKPGQ<br>APRLVIYADDQRASGIPDRFSGSGSGTDFTLTISRLEPEDFAVY<br>YCQSYDIDIDITFGGGTKVEIK |
| CL-25807 | 3328 | EIVLTQSPGTLSLSPGERATLSCRASSGSIGDTYVSWYQQKPGQ<br>APRLLIYADDWRPSGIPDRFSGSGSGTDFTLTISRLEPEDFAVY<br>YCQSYDIEIDIVFGGGTKVEIK |
| CL-25808 | 3329 | EIVLTQSPGTLSLSPGERATLSCERSSGDIWDTYVSWYQQKPGQ<br>APRLVIYSDDQRASGIPDRFSGSGSGTDFTLTISRLEPEDFAVY<br>YCQSYGINIDIVFGGGTKVEIK |
| CL-25809 | 3330 | EIVLTQSPGTLSLSPGERATLSCERSSGDIGETYVSWYQQKPGQ<br>APRLVIYADDQRASGIPDRFSGSGSGTDFTLTISRLEPEDFAVY<br>YCQSYGTIIDIVFGGGTKVEIK |
| CL-25810 | 3331 | EIVLTQSPGTLSLSPGERATLSCERSSGDIWDTYVSWYQQKPGQ<br>APRLVIYADDQRATGIPDRFSGSGSGTDFTLTISRLEPEDFAVY<br>YCQSYDIIIDIVFGGGTKVEIK |
| CL-25812 | 3332 | EIVLTQSPGTLSLSPGERATLSCERSSGDIWYSYVSWYQQKPGQ<br>APRLLIYADDQRASGIPDRFSGSGSGTDFTLTISRLEPEDFAVY<br>YCQSYDIIIDIVFGGGTKVEIK |
| CL-25813 | 3333 | EIVLTQSPGTLSLSPGERATLSCERSSGDIGDSYVSWYQQKPGQ<br>APRLLIYADDYRPSGIPDRFSGSGSGTDFTLTISRLEPEDFAVY<br>YCQSYGIIVDITFGGGTKVEIK |
| CL-25814 | 3334 | EIVLTQSPGTLSLSPGERATLSCERSSGDIGQSYVSWYQQKPGQ<br>APRLVIYSDDQRPSGIPDRFSGSGSGTDFTLTISRLEPEDFAVY<br>YCQSYDIIIDIVFGGGTKVEIK |
| CL-25815 | 3335 | EIVLTQSPGTLSLSPGERATLSCRESSGDILYTYVSWYQQKPGQ<br>APRLVIYSDDQRASGIPDRFSGSGSGTDFTLTISRLEPEDFAVY<br>YCQSYGIEIDITFGGGTKVEIK |
| CL-25816 | 3336 | EIVLTQSPGTLSLSPGERATLSCRASSGDIGHSYVSWYQQKPGQ<br>APRLVIYADDQRPTGIPDRFSGSGSGTDFTLTISRLEPEDFAVY<br>YCQSYGIIIDVTFGGGTKVEIK |
| CL-25818 | 3337 | EIVLTQSPGTLSLSPGERATLSCRASSGDISDSYVSWYQQKPGQ<br>APRLLIYSDDQRPSGIPDRFSGSGSGTDFTLTISRLEPEDFAVY<br>YCQSYGIIIDIVFGGGTKVEIK |
| CL-25819 | 3338 | EIVLTQSPGTLSLSPGERATLSCRASSGSIGHSYVSWYQQKPGQ<br>APRLVIYGDDQRATGIPDRFSGSGSGTDFTLTISRLEPEDFAVY<br>YCQSYDVDIDVVFGGGTKVEIK |
| CL-28175 | 3339 | EIVLTQSPGTLSLSPGERATLSCERSSGDIGDSYVSWYQQKPGQ<br>APRLVIYVDDQRPSGIPDRFSGSGSGTDFTLTISRLEPEDFAVY<br>YCQSYDINIDIVFGGGTKVEIK |
| CL-28178 | 3340 | EIVLTQSPGTLSLSPGERATLSCERSSGDIGDSYVSWYQQKPGQ<br>APRLVIYADDQRPSGIPDRFSGSGSGTDFTLTISRLEPEDFAVY<br>YCQSYDINIDIVCGGGTKVEIK |
| CL-28195 | 3341 | EIVLTQSPGTLSLSPGERATLSCERSSGDIGDSYVSWYQQKPGQ<br>APRLVIYADDQRPSGIPGRFSGSGSGTDFTLTISRLEPEDFAVY<br>YCQSYDINIDIVFGGGTKVEIK |
| CL-28212 | 3342 | EIVLTQSPGTLSLSPGERATLSCERSSGDIGDFYVSWYQQKPGQ<br>APRLVIYADDQRPSGIPDRFSGSGSGTDFTLTISRLEPEDFAVY<br>YCQSYDINIDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-28215 | 3343 | EIVLTQSPGTLSLSPGERATLSCERSSGDIGDYYVSWYQQKPGQ APRLVIYADDQRPSGIPDRFSGSGSGTDFTLTINRMEPEDFAVY YCQSYDINMDIVFGGGTKVEIK |
| CL-28233 | 3344 | EIVLTQSPGTLSLSPGERATLSCERSSGDIGDSYVSWYQQKPGQ APRLVIYGDDQRPSGIPDRFSGSGSGTDFTLTISRLEPEDFAVY YCQSYDINIDIVFGGGTKVEIK |
| CL-29595 | 3345 | EIVLTQSPGTLSLSPGERATLSCRASSGSISYSYVSWYQQKPGQ APRLVIYADDLRATGIPDRFSGSGSGTDFTLTISRLEPEDFAVY YCQSYGINIDVVFGGGTKVEIK |
| CL-29596 | 3346 | EIVLTQSPGTLSLSPGERATLSCERSSGDIWYSYVSWYQQKPGQ APRLLIYADDQRASGIPYRFSGSGSGTDFTLTISRLEPEDFAVY YCQSYDINVDTVFGGGTKVEIK |
| CL-29597 | 3347 | EIVLTQSPGTLSLSPGERATLSCERSSGSIGDAYVSWYQQKPGQ APRLVIYSDDQRPSGIPDRFSGSGSGTDFTLTISRLEPEDFAVY YCQSYGIIVDVVFGGGTKVEIK |
| CL-29598 | 3348 | EIVLTQSPGTLSLSPGERATLSCRASSGSIGDSYVSWYQQKPGQ APRLVIYADDQRASGIPDRFSGSGSGTDFTLTISRLEPEDFAVY YCQSYGIAIDIVFGGGTKVEIK |
| CL-29599 | 3349 | EIVLTQSPGTLSLSPGERATLSCRASSGSIEYSYVSWYQQKPGQ APRLVIYADDQRASGIPDRFSGSGSGTDFTLTISRLEPEDFAVY YCQSYGIIVDIVFGGGTKVEIK |
| CL-29600 | 3350 | EIVLTQSPGTLSLSPGERATLSCRASSGSIEGAYVSWYQQKPGQ APRLVIYSDDERATGIPDRFSGSGSGTDFTLTISRLEPEDFAVY YCQSYGIITDIVFGGGTKVEIK |
| CL-29601 | 3351 | EIVLTQSPGTLSLSPGERATLSCERSSGSIGGTYVSWYQQKPGQ APRLVIYADDLRASGIPDRFSGSGSGTDFTLTISRLEPEDFAVY YCQSYDIEIDITFGGGTKVEIK |
| CL-29602 | 3352 | EIVLTQSPGTLSLSPGERATLSCERSSGDIGSCYVSWYQQKPGQ APRLVIYADDQRASGIPDRFSGSGSGTDFTLTISRLEPEDFAVY YCQSYDIDIDVVFGGGTKVEIK |
| CL-29603 | 3353 | EIVLTQSPGTLSLSPGERATLSCRASSGDIGYTYVSWYQQKPGQ APRLVIYADDVRPSGIPDRFSGSGSGTDFTLTISRLEPEDFAVY YCQSYGIDVDIVFGGGTKVEIK |
| CL-29604 | 3354 | EIVLTQSPGTLSLSPGERATLSCERSSGSIWGYYVSWYQQKPGQ APRLVIYADDHRASGIPDRFSGSGSGTDFTLTISRLEPEDFAVY YCQSYDIIIDITFGGGTKVEIK |
| CL-29605 | 3355 | EIVLTQSPGTLSLSPGERATLSCERSSGDIGEAYVSWYQQKPGQ APRLVIYADDQRPSGIPDRFSGSGSGTDFTLTISRLEPEDFAVY YCQSYDIIIDITFGGGTKVEIK |
| CL-29606 | 3356 | EIVLTQSPGTLSLSPGERATLSCERSSGDIGYSYVSWYQQKPGQ APRLLIYSDDNRASGIPDRFSGSGSGTDFTLTISRLEPEDFAVY YCQSYGTIIDITFGGGTKVEIK |
| CL-29607 | 3357 | EIVLTQSPGTLSLSPGERATLSCERSSGDIGYSYVSWYQQKPGQ APRLVIYADDQRASGIPDRFSGSGSGTDFTLTISRLEPEDFAVY YCQSYDITIDIVFGGGTKVEIK |
| CL-29608 | 3358 | EIVLTQSPGTLSLSPGERATLSCERSSGDIWYSYVSWYQQKPGQ APRLLIYADDQRATGIPDRFSGSGSGTDFTLTISRLEPEDFAVY YCQSYDLIIDVVFGGGTKVEIK |
| CL-29609 | 3359 | EIVLTQSPGTLSLSPGERATLSCERSSGDIWHSYVSWYQQKPGQ APRLVIYADDQRPSGIPDRFSGSGSGTDFTLTISRLEPEDFAVY YCQSYDIIIDITFGGGTKVEIK |
| CL-29610 | 3360 | EIVLTQSPGTLSLSPGERATLSCRASSGDIGDSYVSWYQQKPGQ APRLVIYADDDRPSGIPDRFSGSGSGTDFTLTISRLEPEDFAVY YCQSYGIDVDVTFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-29611 | 3361 | EIVLTQSPGTLSLSPGERATLSCRASSGDIAHSYVSWYQQKPGQ<br>APRLLIYVDDLRATGIPDRFSGSGSGTDFTLTISRLEPEDFAVY<br>YCQSYDITIDIVFGGGTKVEIK |
| CL-29612 | 3362 | EIVLTQSPGTLSLSPGERATLSCERSSGDIYSYVSWYQQKPGQ<br>APRLLIYSDDQRPSGIPDRFSGSGSGTDFTLTISRLEPEDFAVY<br>YCQSYDLNIDVVFGGGTKVEIK |
| CL-29613 | 3363 | EIVLTQSPGTLSLSPGERATLSCRASSGDISESYVSWYQQKPGQ<br>APRLLIYTDDLRPTGIPDRFSGSGSGTDFTLTISRLEPEDFAVY<br>YCQSYDIDTDIVFGGGTKVEIK |
| CL-29614 | 3364 | EIVLTQSPGTLSLSPGERATLSCERSSGDIGDSLVSWYQQKPGQ<br>APRLVIYADDQRASGIPDRFSGSGSGTDFTLTISRLEPEDFAVY<br>YCQSYGVIVDIVFGGGTKVEIK |
| CL-29615 | 3365 | EIVLTQSPGTLSLSPGERATLSCRASSGDIYESYVSWYQQKPGQ<br>APRLVIYADDQRATGIPDRFSGSGSGTDFTLTISRLEPEDFAVY<br>YCQSYDVTIDIVFGGGTKVEIK |
| CL-29617 | 3366 | EIVLTQSPGTLSLSPGERATLSCERSSGDIGFAYVSWYQQKPGQ<br>APRLLIYADDQRASGIPDRFSGSGSGTDFTLTISRLEPEDFAVY<br>YCQSYGIDIDIVFGGGTKVEIK |
| CL-29618 | 3367 | EIVLTQSPGTLSLSPGERAPLSCERSSGSIWDSYVSWYQQKPGQ<br>APRLVIYADDQRASGIPDRFSGSGSGTDFTLTISRLEPEDFAVY<br>YCQSYDVDIDIVFGGGTKVEIK |
| CL-29620 | 3368 | EIVLTQSPGTLSLSPGERATLSCERSSGDIWDSYVSWYQQKPGQ<br>APRLVIYSDDQRATGIPDRFSGSGSGTDFTLTISRLEPEDFAVY<br>YCQSYGIIIDITFGGGTKVEIK |
| CL-29621 | 3369 | EIVLTQSPGTLSLSPGERATLSCRASSGSIGYSYVSWYQQKPGQ<br>APRLVIYADDRRASGIPDRFSGSGSGTDFTLTISRLEPEDFAVY<br>YCQSYDIIRDIVFGGGTKVEIK |
| CL-29622 | 3370 | EIVLTQSPGTLSLSPGERATLSCERSSGDIGYSYVSWYQQKPGQ<br>APRLVIYADDQRASGIPDRFSGSGSGTDFTLTISRLEPEDFAVY<br>YCQSYGIIVDIVFGGGTKVEIK |
| CL-29623 | 3371 | EIVLTQSPGTLSLSPGERATLSCRASSGSIWYSYVSWYQQKPGQ<br>APRLVIYSDDQRASGIPDRFSGSGSGTDFTLTISRLEPEDFAVY<br>YCQSYGINIDVTFGGGTKVEIK |
| CL-29624 | 3372 | EIVLTQSPGTLSLSPGERATLSCERSSGDIWDSYVSWYQQKPGQ<br>APRLVIYSDDQRPSGIPDRFSGSGSGTDFTLTISRLEPEDFAVY<br>YCQSYGIIIDIVFGGGTKVEIK |
| CL-29625 | 3373 | EIVLTQSPGTLSLSPGERATLSCERSSGDIGYFYVSWYQQKPGQ<br>APRLVIYVDDQRASGIPDRFSGSGSGTDFTLTISRLEPEDFAVY<br>YCQSYGINIDVVFGGGTKVEIK |
| CL-29626 | 3374 | EIVLTQSPGTLSLSPGERATLSCRASSGSIGDTYVSWYQQKPGQ<br>APRLLIYSDDHRPTGIPDRFSGSGSGTDFTLTISRLEPEDFAVY<br>YCQSYDINIDIVFGGGTKVEIK |
| CL-29627 | 3375 | EIVLTQSPGTLSLSPGERATLSCRASSGDIWYSFVSWYQQKPGQ<br>APRLLIYADDQRATGIPDRFSGSGSGTDFTLTISRLEPEDFAVY<br>YCQSYGIISDIVFGGGTKVEIK |
| CL-29628 | 3376 | EIVLTQSPGTLSLSPGERATLSCERSSGSIGETYVSWYQQKPGQ<br>APRLVIYADDLRATGIPDRFSGSGSGTDFTLTISRLEPEDFAVY<br>YCQSYGIIVDIVFGGGTKVEIK |
| CL-29629 | 3377 | EIVLTQSPGTLSLSPGERATLSCRASSGDIGDCFVSWYQQKPGQ<br>APRLVIYADDQRPSGIPDRFSGSGSGTDFTLTISRLEPEDFAVY<br>YCQSYGINIDVVFGGGTKVEIK |
| CL-29630 | 3378 | EIVLTQSPGTLSLSPGERATLSCRASSGDIRHSFVSWYQQKPGQ<br>APRLVIYWDDYRPSGIPDRFSGSGSGTDFTLTISRLEPEDFAVY<br>YCQSYDIDIDVTFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-29631 | 3379 | EIVLTQSPGTLSLSPGERATLSCERSSGSIDECYVSWYQQKPGQ<br>APRLVIYADDDRATGIPDRFSGSGSGTDFTLTISRLEPEDFAVY<br>YCQSYDIDIDVVFGGGTKVEIK |
| CL-29632 | 3380 | EIVLTQSPGTLSLSPGERATLSCERSSGDIGESYVSWYQQKPGQ<br>APRLVIYTDDRRASGIPDRFSGSGSGTDFTLTISRLEPEDFAVY<br>YCQSYGSNIDVVFGGGTKVEIK |
| CL-29634 | 3381 | EIVLTQSPGTLSLSPGERATLSCERSSGDIGYSYVSWYQQKPGQ<br>APRLVIYADDQRASGIPDRFSGSGSGTDFTLTISRLEPEDFAVY<br>YCQQYDIDTDIVFGGGTKVEIK |
| CL-29635 | 3382 | EIVLTQSPGTLSLSPGERATLSCERSSGDIGHSYVSWYQQKPGQ<br>APRLVIYSDDQRASGIPDRFSGSGSGTDFTLTISRLEPEDFAVY<br>YCQSYDIIIDITFGGGTKVEIK |
| CL-29636 | 3383 | EIVLTQSPGTLSLSPGERATLSCRASSGDICHSYVSWYQQKPGQ<br>APRLVIYADDQRATGIPDRFSGSGSGTDFTLTISRLEPEDFAVY<br>YCQSYDIIVDIVFGGGTKVEIK |
| CL-29637 | 3384 | EIVLTQSPGTLSLSPGERATLSCERSSGSINESYVSWYQQKPGQ<br>APRLVIYADDQRASGIPDRFSGSGSGTDFTLTISRLEPEDFAVY<br>YCQSYGIDIDIVFGGGTKVEIK |
| CL-29638 | 3385 | EIVLTQSPGTLSLSPGERATLSCERSSGSIWYSYVSWYQQKPGQ<br>APRLLIYADDQRASGIPDRFSGSGSGTDFTLTISRLEPEDFAVY<br>YCQSYDIDIDVTFGGGTKVEIK |
| CL-29639 | 3386 | EIVLTQSPGTLSLSPGERATLSCERSSGDIWDTYVSWYQQKPGQ<br>APRLLIYADDERASRIPDRFSGSGSGTDFTLTISRLEPEDFAVY<br>YCQSYGIDIDVVFGGGTKVEIK |
| CL-29640 | 3387 | EIVLTQSPGTLSLSPGERATLSCRASSGDIWYSYVSWYQQKPGQ<br>APRLVIYADDQRPTGIPDRFSGSGSGTDFTLTISRLEPEDFAVY<br>YCQSYDIDIDITFGGGTKVEIK |
| CL-29641 | 3388 | EIVLTQSPGTLSLSPGERATLSCERSSGDIWQSYVSWYQQKPGQ<br>APRLLIYADDQRASGIPDRFSGSGSGTDFTLTISRLEPEDFAVY<br>YCQSYDIVIDITFGGGTKVEIK |
| CL-29642 | 3389 | EIVLTQSPGTLSLSPGERATLSCERSSGDIWYSYVSWYQQKPGQ<br>APRLLIYSDDQRASGIPDRFSGSGSGTDFTLTISRLEPEDFAVY<br>YCQSYDIIIDIVFGGGTKVEIK |
| CL-29643 | 3390 | EIVLTQSPGTLSLSPGERATLSCERSSGDIGDYYVSWYQQKPGQ<br>APRLVIYSDDQRPTGIPDRFSGSGSGTDFTLTISRLEPEDFAVY<br>YCQSYDLIIDITFGGGTKVEIK |
| CL-29644 | 3391 | EIVLTQSPGTLSLSPGERATLSCRASSGDIGYTYVSWYQQKPGQ<br>APRLVIYSDDHRASGIPDRFSGSGSGTDFTLTISRLEPEDFAVY<br>YCQSYGIIVDIVFGGGTKVEIK |
| CL-29645 | 3392 | EIVLTQSPGTLSLSPGERATLSCERSSGDISGAYVSWYQQKPGQ<br>APRLVIYGDDERASGIPDRFSGSGSGTDFTLTISRLEPEDFAVY<br>YCQSYDIIIDVTFGGGTKVEIK |
| CL-29646 | 3393 | EIVLTQSPGTLSLSPGERATLSCRASSGDIGRSYVSWYQQKPGQ<br>APRLVIYADDLRASGIPDRFSGSGSGTDFTLTISRLEPEDFAVY<br>YCQSYDVNTDIVFGGGTKVEIK |
| CL-29647 | 3394 | EIVLTQSPGTLSLSPGERATLSCERSSGSIWHTYVSWYQQKPGQ<br>APRLVIYADDQRPSGIPDRFSGSGSGTDFTLTISRLEPEDFAVY<br>YCQSYGIIIDITFGGGTKVEIK |
| CL-29648 | 3395 | EIVLTQSPGTLSLSPGERATLSCERSSGDIGYAYVSWYQQKPGQ<br>APRLLIYADDQRASGIPDRFSGSGSGTDFTLTISRLEPEDFAVY<br>YCQSYDIILDVTFGGGTKVEIK |
| CL-29649 | 3396 | EIVLTQSPGTLSLSPGERATLSCRASSGDIEHSYVSWYQQKPGQ<br>APRLLIYVDDQRPTGIPDRFSGSGSGTDFTLTISRLXPEDFAVY<br>YCQSYGIREDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-29650 | 3397 | EIVLTQSPGTLSLSPGERATLSCERSSGSIGFSYVSWYQQKPGQ APRLVIYADDLRATGIPDRFSGSGSGTDFTLTISRLEPEDFAVY YCQSYGTYVDVVFGGGTKVEIK |
| CL-29651 | 3398 | EIVLTQSPGTLSLSPGERATLSCRASSGDIWYSYVSWYQQKPGQ APRLVIYSDDERPTGIPDRFSGSGSGTDFTLTISRLEPEDFAVY YCQSYGVDVDVVFGGGTKVEIK |
| CL-29652 | 3399 | EIVLTQSPGTLSLSPGERATLSCERSSGDIGYSYVSWYQQKPGQ APRLVIYADDQRASGIPDRFSGSGSGTDFTLTISRLEPEDFAVY YCQSYDIIIDIVFGGGTKVEIK |
| CL-29653 | 3400 | EIVLTQSPGTLSLSPGERATLSCRASSGDIEHSYVSWYQQKPGQ APRLLIYADDYRPTGIPDRFSGSGSGTDFTLTISRLEPEDFAVY YCQSYGIDPDITFGGGTKVEIK |
| CL-29654 | 3401 | EIVLTQSPGTLSLSPGERATLSCRASSGDISHSYVSWYQQKPGQ APRLVIYADDQRATGIPDRFSGSGSGTDFTLTISRLEPEDFAVY YCQSYDIDIDITFGGGTKVEIK |
| CL-29655 | 3402 | EIVLTQSPGTLSLSPGERATLSCERSSGDIGDAYVSWYQQKPGQ APRLVIYADDQRASGIPDRFSGSGSGTDFTLTISRLEPEDFAVY YCQSYGIFIDIVFGGGTKVEIK |
| CL-29656 | 3403 | EIVLTQSPGTLSLSPGERATLSCERSSGDIGEYYVSWYQQKPGQ APRLVIYADDRRPTGIPDRFSGSGSGTDFTLTISRLEPEDFAVY YCQSYDIDIDVTFGGGTKVEIK |
| CL-29657 | 3404 | EIVLTQSPGTLSLSPGERATLSCERSSGSIDYAYVSWYQQKPGQ APRLVIYSDDYRATGIPDRFSGSGSGTDFTLTISRLEPEDFAVY YCQSYDIDIDITFGGGTKVEIK |
| CL-29658 | 3405 | EIVLTQSPGTLSLSPGERATLSCRASSGDIWYSYVSWYQQKPGQ APRLLIYADDQRASGIPDRFSGSGSGTDFTLTISRLEPEDFAVY YCQSYGIVIDIVFGGGTKVEIK |
| CL-29659 | 3406 | EIVLTQSPGTLSLSPGERATLSCERSSGSIGYSYVSWYQQKPGQ APRLVMYADDQRASGIPDRFSGSGSGTDFTLTISRLEPEDFAVY YCQSYDVIIDVVFGGGTKVEIK |
| CL-29660 | 3407 | EIVLTQSPGTLSLSPGERATLSCRASSGDIGYSYVSWYQQKPGQ APRLVIYSDDQRASGIPDRFSGSGSGTDFTLTISRLEPEDFAVY YCQSYDIIIDVTFGGGTKVEIK |
| CL-29661 | 3408 | EIVLTQSPGTLSLSPGERATLSCRASSGSIWHSYVSWYQQKPGQ APRLVIYADDQRATGIPDRFSGSGSGTDFTLTISRLEPEDFAVY YCKSYGINIDVTFGGGTKVEIK |
| CL-29662 | 3409 | EIVLTQSPGTLSLSPGERATLSCERSSGDIGYSYVSWYQQKPGQ APRLVIYSDDQRPSGIPDRFSGSGSGTDFTLTISRLEPEDFAVY YCQSYDINIDVVFGGGTKVEIK |
| CL-29663 | 3410 | EIVLTQSPGTLSLSPGERATLSCERSSGDIGDTYVSWYQQKPGQ APRLVIYADDQRASGIPDRFSGSGSGTDFTLTISRLEPEDFAVY YCQSYGIDIDITFGGGTKVEIK |
| CL-29664 | 3411 | EIVLTQSPGTLSLSPGERATLSCRASSGDIRHSYVSWYQQKPGQ APRLVIYADDDRASGIPDRFSGSGSGTDFTLTISRLEPEDFAVY YCQSYGINTDIVFGGGTKVEIK |
| CL-29665 | 3412 | EIVLTQSPGTLSLSPGERATLSCRASSGDIGGSYVSWYQQKPGQ APRLVIYTDDWRASGIPDRFSGSGSGTDFTLTISRLEPEDFAVY YCQSYGINIDVVFGGGTKVEIK |
| CL-29666 | 3413 | EIVLTQSPGTLSLSPGERATLSCRASSGDISYSYVSWYQQKPGQ APRLLIYADDQRATGIPDRFSGSGSGTDFTLTISRLEPEDFAVY YCQSYGIIIDVVFGGGTKVEIK |
| CL-29667 | 3414 | EIVLTQSPGTLSLSPGERATLSCERSSGDIGDMYVSWYQQKPGQ APRLVIYSDDQRPSGIPDRFSGSGSGTDFTLTISRLEPEDFAVY YCQSYDIIIDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-29668 | 3415 | EIVLTQSPGTLSLSPGERATLSCERSSGDIDYTYVSWYQQKPGQ APRLLIYADDQRASGIPDRFSGSGSGTDFTLTISRLEPEDFAVY YCQSYDLTLDITFGGGTKVEIK |
| CL-29669 | 3416 | EIVLTQSPGTLSLSPGERATLSCERSSSSIWHSYVSWYQQKPGQ APRLVIYADDYRASGIPDRFSGSGSGTDFTLTISRLEPEDFAVY YCQSYDIDIDVVFGGGTKVEIK |
| CL-29670 | 3417 | EIVLTQSPGTLSLSPGERATLSCRASSGSIDYSYVSWYQQKPGQ APRLVIYADDQRASGIPDRFSGSGSGTDFTLTISRLEPEDFAVY YCQSYGIYIDVVFGGGTKVEIK |
| CL-29671 | 3418 | EIVLTQSPGTLSLSPGERATLSCRASSGSIWYSFVSWYQQKPGQ APRLVIYADDQRASGIPDRFSGSGSGTDFTLTISRLEPEDFAVY YCQSYGQYIDVVFGGGTKVEIK |
| CL-29672 | 3419 | EIVLTQSPGTLSLSPGERATLSCRASSGDIDESYVSWYQQKPGQ APRLVIYADDQRATGIPDRFSGSGSGTDFTLTISRLEPEDFAVY YCQSYGIIIDIVFGGGTKVEIK |
| CL-29673 | 3420 | EIVLTQSPGTLSLSPGERATLSCRASSGDIXYSYVSWYQQKPGQ APRLVIYSDDQRATGIPDRFSGSGSGTDFTLTISRLEPEDFAVY YCQSYDSIIDVTFGGGTKVEIK |
| CL-29674 | 3421 | EIVLTQSPGTLSLSPGERATLSCRASSGDIWYSYVSWYQQKPGQ APRLLIYADDQRPSGIPDRFSGSGSGTDFTLTISRLEPEDFAVY YCQSYGINVDIVFGGGTKVEIK |
| CL-29675 | 3422 | EIVLTQSPGTLSLSPGERATLSCERSSGSIMYAYVSWYQQKPGQ APRLVIYADDQRPTGIPDRFSGSGSGTDFTLTISRLEPEDFAVY YCQSYDLIIDVTFGGGTKVEIK |
| CL-29676 | 3423 | EIVLTQSPGTLSLSPGERATLSCERSSGDIGDTYVSWYQQKPGQ APRLVIYADDARATGIPDRFSGSGSGTDFTLTISRLEPEDFAVY YCQSYDLDIDITFGGGTKVEIK |
| CL-29677 | 3424 | EIVLTQSPGTLSLSPGERATLSCERSSGDIWHSYVSWYQQKPGQ APRLVIYADDQRASGIPDRFSGSGSGTDFTLTISRLEPEDFAVY YCQSYDISIDVTFGGGTKVEIK |
| CL-29678 | 3425 | EIVLTQSPGTLSLSPGERATLSCERSSGSIGETYVSWYQQKPGQ APRLLIYSDDQRATGIPDRFSGSGSGTDFTLTISRLEPEDFAVY YCQSYGIDIDIVFGGGTKVEIK |
| CL-29679 | 3426 | EIVLTQSPGTLSLSPGERATLSCRASSGSIGDSYVSWYQQKPGQ APRLLIYSDDDRPTGIPDRFSGSGSGTDFTLTISRLEPEDFAVY YCQSYGISIDVTFGGGTKVEIK |
| CL-29681 | 3427 | EIVLTQSPGTLSLSPGERATLSCRASSGDIGHSYVSWYQQKPGQ APRLLIYADDQRASGIPDRFSGSGSGTDFTLTISRLEPEDFAVY YCQSYDIIIDITFGGGTKVEIK |
| CL-29682 | 3428 | EIVLTQSPGTLSLSPGERATLSCERSSGDIGDTYVSWYQQKPGQ APRLVIYSDDQRPSGIPDRFSGSGSGTDFTLTISRLEPEDFAVY YCQSYGIIIDIVFGGGTKVEIK |
| CL-29683 | 3429 | EIVLTQSPGTLSLSPGERATLSCERSSGDIYSYVSWYQQKPGQ APRLLIYSDDQRPSGIPDRFSGSGSGTDFTLTISRLEPEDFAVY YCQSYGINIDVTFGGGTKVEIK |
| CL-29684 | 3430 | EIVLTQSPGTLSLSPGERATLSCERSSGSIWHSYVSWYQQKPGQ APRLVIYSDDQQASGIPDRFSGSGSGTDFTLTISRLEPEDFAVY YCQSYDIIIDIVFGGGTKVEIK |
| CL-29685 | 3431 | EIVLTQSPGTLSLSPGERATLSCERSSGDIGYSYVSWYQQKPGQ APRLVIYADDQRATGIPDRFSGSGSGTDFTLTISRLEPEDFAVY YCQSYGIVIDIVFGGGTKVEIK |
| CL-29686 | 3432 | EIVLTQSPGTLSLSPGERATLSCERSSGDIGDTYVSWYQQKPGQ APRLVIYADDQRPTGIPDRFSGSGSGTDFTLTISRLEPEDFAVY YCQSYDLTIDIVFGGGTKVEIK |

TABLE 47-continued

List of Amino Acid Sequences Of Affinity Matured hBDI-9E8.4 VL Variants

| Clone | SEQ ID NO: | VL |
|---|---|---|
| CL-29687 | 3433 | EIVLTQSPGTLSLSPGERATLSCERSSGDIGDSYVSWYQQKPGQAPRLVIYSDDQRASGIPDRFSGSGSGTDFTLTISRLEPEDFAVYYCQSYDICIDVTFGGGTKVEIK |
| CL-29688 | 3434 | EIVLTQSPGTLSLSPGERATLSCERSSGDIGDSYVSWYQQKPGQAPRLLIYSDDHRPSGIPDRFSGSGSGTDFTLTISRLEPEDFAVYYCQSYGIIDIVFGGGTKVEIK |
| CL-29689 | 3435 | EIVLTQSPGTLSLSPGERATLSCERSSGSIGGYYVSWYQQKPGQAPRLLIYADDQRATGIPDRFSGSGSGTDFTLTISRLEPEDFAVYYCQSYGIIDIVFGGGTKVEIK |
| CL-29690 | 3436 | EIVLTQSPGTLSLSPGERATLSCERSSGDIGYSYVSWYQQKPGQAPRLVIYGADLRASGIPDRFSGSGSGTDFTLTISRLEPEDFAVYYCQSYGIDIDIVFGGGTKVEIK |
| CL-29722 | 3437 | EIVLTQSPGTLSLSPGERATLSCERSXGDIGDSYVSWYQQKPGQAPRLVIYADDQRPSGIPDRFSGSGSGTDFTLTISRLEPEDFAVYYCQSYDINIDIVFGGGTKVEIK |
| CL-29732 | 3438 | EIVLTQSPGTLSLSPGERATLSCERSSVDIGDSYVSWYQQKPGQAPRLVIYADDQRPSGIPDRFSGSGSGTDFTLTISRLEPEDFAVYYCQSYDINIDIVFGGGTKVEIK |
| CL-29741 | 3439 | EIVLTQSPGTLSLSPGERATLSCERSSGDIGDSYVSWYQQKPGQAPRLVIHADDQRPSGIPDRFSGSGSGTDFTLTISRLEPEDFAVYYCQSYDINIDIVFGGGTKVEIK |
| CL-29746 | 3440 | EIVLTQSPGTLSLSPGERATLSCERSSGDIGDSYVSWYQQKPVQAPRLVIYADDQRPSGIPDRFSGSGSGTDFTLTISRLEPEDFAVYYCQSYDINIDIVFGGGTKVEIK |
| CL-29756 | 3441 | EIVLTQSPGTLSLSPGERATLSCERSSGDIGDSYVSWYQQKPGQATRLVIYADDQRPSGIPDRFSGSGSGTDFTLTISRLEPEDFAVYYCQSYDINIDIVFGGGTKVEIK |
| CL-29759 | 3442 | EIVLTQSPGTLSLSPGERATLSCERSSGDIGDSYVSWYQQKPGQAPRLVIYAYDQRPSGIPDRFSGSGSGTDFTLTISRLEPEDFAVYYCQSYDINIDIVFGGGTKVEIK |
| CL-29765 | 3443 | EIVLTQSPGTLSLSPGERATLSCERSSGDIGDSYVSWYQQKPGQAPRLVIYSDDQRPSGIPDRFSGSGSGTDFTLTISRLEPEDFAVYYCQSYDINIDIVFGGGTKVEIK |
| CL-29771 | 3444 | EXXLTQSPGTLSLSPGERATXSCERSSGDXGDSYVSWYQQKPGQAPRLVIYXDDQRPSGIPDRFSGSGSGTDFTLTISGLEPEDFAVYYCQSXDINMDIVFGGGTKVEIK |
| CL-29780 | 3445 | EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGVGTKVEIK |
| CL-29781 | 3446 | EIVLTQSPGTLSLSPGERATLSCERSSGDIGDSYVSWYQQKPGQAPRLVIYADDQRPSGIPDRFSGSGSGTDFTLTISRLEPEDFVVYYCQSYDINIDIVFGGGTKVEIK |
| CL-33580 | 3447 | EIVLTQSPGTLSLSPGERATLSCERSSGDIGDSYVSWYQQKPGQAPRLVIYXDDQRPSGIPDRFSGSGSGGDFTLTISRLEPEDFAVYYCQSYDINIDIVFGGGTKVEIK |
| CL-33673 | 3448 | EIVLTQSPGTLSLSPGERATLSCERSSGDIWEYYVSWYQQKPGQAPRLVIYADDQRATGIPDRFSGSGSGTDFTLTISRLEPEDFAVYYCQSYDLEVDIVFGGGTKVEIK |
| CL-33674 | 3449 | EIVLTQSPGTLSLSPGERATLSCERSSGSIWDTYVSWYQQKPGQAPRLVIYSDDQRATGIPDRFSGSGSGTDFTLTISRLEPEDFAVYYCQSYGINVDIVFGGGTKVEIK |
| CL-33676 | 3450 | EIVLTQSPGTLSLSPGERATLSCERSSGDIWGYYVSWYQQKPGQAPRLLIYADDLRASGIPDRFSGSGSGTDFTLTISRLEPEDFAVYYCQSYDINIDVVFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-33677 | 3451 | EIVLTQSPGTLSLSPGERATLSCERSSGSIYYTYVSWYQQKPGQ APRLVIYADDQRASGIPDRFSGSGSGTDFTLTISRLEPEDFAVY YCQSYDIDVDVVFGGGTKVEIK |
| CL-33678 | 3452 | EIVLTQSPGTLSLSPGERATLSCERSSGDIWGYYVSWYQQKPGQ APRLLIYADDLRASGIPDRFSGSGSGTDFTLTISRLEPEDFAVY YCQSYGIDIDITFGGGTKVEIK |
| CL-33679 | 3453 | EIVLTQSPGTLSLSPGERATLSCERSSGDIWDTYVSWYQQKPGQ APRLVIYADDQRATGIPDRFSGSGSGTDFTLTISRLEPEDFAVY YCQSYGLNVDVVFGGGTKVEIK |
| CL-33680 | 3454 | EIVLTQSPGTLSLSPGERATLSCERSSGDIYETYVSWYQQKPGQ APRLVIYSDDHRPSGIPDRFSGSGSGTDFTLTISRLEPEDFAVY YCQSYDIDIDVVFGGGTKVEIK |
| CL-33681 | 3455 | EIVLTQSPGTLSLSPGERATLSCERSSGSIWYSYVSWYQQKPGQ APRLLIYADDQRATGIPDRFSGSGSGTDFTLTISRLEPEDFAVY YCQSYGIITDVTFGGGTKVEIK |
| CL-33684 | 3456 | EIVLTQSPGTLSLSPGERATLSCERSSGDIWGYYVSWYQQKPGQ APRLLIYADDLRASGIPDRFSGSGSGTDFTLTISRLEPEDFAVY YCQSYDINIDVVFGGGTEVEIK |
| CL-33685 | 3457 | EIVLTQSPGTLSLSPGERATLSCERSSGDIYYTYVSWYQQKPGQ APRLVIYADDQRASGIPDRFSGSGSGTDFTLTISRLEPEDFAVY YCQSYGINIDVVFGGGTKVEIK |
| CL-33687 | 3458 | EIVLTQSPGTLSLSPGERATLSCERSSGDIWDYYVSWYQQKPGQ APRLVIYADDQRASGIPDRFSGSGSGTDFTLTISRLEPEDFAVY YCQSYDLDIDVVFGGGTKVEIK |
| CL-33688 | 3459 | EIVLTQSPGTLSLSPGERATLSCERSSGSIWQSYVSWYQQKPGQ APRLVIYADDQRPSGIPDRFSGSGSGTDFTLTISRLEPEDFAVY YCQSYDIIIDIVFGGGTKVEIK |
| CL-33690 | 3460 | EIVLTQSPGTLSLSPGERATLSCKRSSGSIYDTYVSWYQQKPGQ APRLVIYSDDQRPSGIPDRFSGSGSGTDFTLTISRLEPEDFAVY YCQSYDVDSDIVFGGGTKVEIK |
| CL-33691 | 3461 | EIVLTQSPGTLSLSPGERATLSCERSSGDIWDYYVSWYQQKPGQ APRLVIYADDQRPSGIPDRFSGSGSGTDFTLTISRLEPEDFAVY YCQSYGIDIDVTFGGGTKVEIK |
| CL-33692 | 3462 | EIVLTQSPGTLSLSPGERATLSCERSSGDIWDYYVSWYQQKPGQ APRLVIYADDQRASGIPDRFSGSGSGTDFTLTISRLEPEDFAVY YCQSYDLDIDVTFGGGTKVEIK |
| CL-33693 | 3463 | EIVLTQSPGTLSLSPGERATLSCERSSGSIYESYVSWYQQKPGQ APRLLIYSDDQRPTGIPDRFSGSGSGTDFTLTISRLEPEDFAVY YCQSYGIDIDVVFGGGTKVEIK |
| CL-33694 | 3464 | EIVLTQSPGTLSLSPGERATLSCERSSGSIYHTYVSWYQQKPGQ APRLVIYADDQRASGIPDRFSGSGSGTDFTLTISRLEPEDFAVY YCQSYDLDIDVTFGGGTKVEIK |
| CL-33695 | 3465 | EIVLTQSPGTLSLSPGERATLSCERSSGSIYDTYVSWYQQKPGQ APRLVIYSDDQRPTGIPDRFSGSGSGTDFTLTISRLEPEDFAVY YCQSYDLDIDIVFGGGTKVEIK |
| CL-33697 | 3466 | EIVLTQSPGTLSLSPGERATLSCERSSGDIWQTYVSWYQQKPGQ APRLVIYADDQRASGIPDRFSGSGSGTDFTLTISRLEPEDFAVY YCQSYDIDVDIVFGGGTKVEIK |
| CL-33698 | 3467 | EIVLTQSPGTLSLSPGERATLSCERSSGDIWXYYVSWYQQKPGQ APRLVIYADDQRPSGIPDRFSGSGSGTDFTLTISRLEPEDFAVY YCQSYDLFIDVTFGGGTKVEIK |
| CL-33700 | 3468 | EIVLTQSPGTLSLSPGERATLSCERSSGDIWHYYVSWYQQKPGQ APRLLIYADDQRASGIPDRFSGSGSGTDFTLTISRLEPEDFAVY YCQSYDLEIDVTFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-33704 | 3469 | EIVLTQSPGTLSLSPGERATLSCERSSGDIWSYYVSWYQQKPGQ APRLVIYADDQRASGIPDRFSGSGSGTDFTLTISRLEPEDFAVY YCQSYDLTVDVVFGGGTKVEIK |
| CL-33707 | 3470 | EIVLTQSPGTLSLSPGERATLSCERSSGDIWSYYVSWYQQKPGQ APRLVIYADDQRASGIPDRFSGSGSGTDFTLTISRLEPEDFAVY YCQSYDLDIDVTFGGGTKVEIK |
| CL-33708 | 3471 | EIVLTQSPGTLSLSPGERATLSCERSSGDIWDYYVSWYQQKPGQ APRLVIYADDQRATGIPDRFSGSGSGTDFTLTISRLEPEDFAVY YCQSYDIDIDVTFGGGTKVEIK |
| CL-33709 | 3472 | EIVLTQSPGTLSLSPGERATLSCERSSGDIWQTYVSWYQQKPGQ APRLVIYADDQRASGIPDRFSGSGSGTDFTLTISRLEPEDFAVY YCQSYDIDIDVTFGGGTKVEIK |
| CL-33710 | 3473 | EIVLTQSPGTLSLSPGERATLSCERSSGDIWEYYVSWYQQKPGQ APRLVIYADDQRATGIPDRFSGSGSGTDFTLTISRLEPEDFAVY YCQSYDLDIDVVFGGGTKVEIK |
| CL-33712 | 3474 | EIVLTQSPGTLSLSPGERATLSCRASSGSIYYSYVSWYQQKPGQ APRLVIYADDQRATGIPDRFSGSGSGTDFTLTISRLEPEDFAVY YCQSYDIDIDVVFGGGTKVEIK |
| CL-33713 | 3475 | EIVLTQSPGTLSLSPGERATLSCERYSGDIWYTYVSWYQQKPGQ APRLVIYADDQRATGIPDRFSGSGSGTDFTLTISRLEPEDFAVY YCQSYDIDVDVVFGGGTKVEIK |
| CL-33716 | 3476 | EIVLTQSPGTLSLSPGERATLSCERSSGDIWEYYVSWYQQKPGQ APRLVIYADDLRATGIPDRFSGSGSGTDFTLTISRLEPEDFAVY YCQSYDLDIDVTFGGGTKVEIK |
| CL-33718 | 3477 | EIVLTQSPGTLSLSPGERATLSCERSSGDIWEYYVSWYQQKPGQ APRLLIYADDQRASGIPDRFSGSGSGTDFTLTISRLEPEDFAVY YCQSYDLNIDVVFGGGTKVEIK |
| CL-33719 | 3478 | EIVLTQSPGTLSLSPGERATLSCERSSGDIWEYYVSWYQQKPGQ APRLVIYADDLRASGIPDRFSGSGSGTDFTLTISRLEPEDFAVY YCQSYDLDIDVTFGGGTKVEIK |
| CL-33720 | 3479 | EIVLTQSPGTLSLSPGERATLSCERSSGDIWEYYVSWYQQKPGQ APRLVIYTDDLRASGIPDRFSGSGSGTDFTLTISRLEPEDFAVY YCQSYDIETDIVFGGGTKVEIK |
| CL-33721 | 3480 | EIVLTQSPGTLSLSPGERATLSCERSSGDIWYSYVSWYQQKPGQ APRLVIYADDQRATGIPDRFSGSGSGTDFTLTISRLEPEDFAVY YCQSYDIDVDVTFGGGTKVEIK |
| CL-33722 | 3481 | EIVLTQSPGTLSLSPGERATLSCERSSGDIWYSYVSWYQQKPGQ APRLVIYADDQRATGIPDRFSGSGSGTDFTLTISRLEPEDFAVY YCQSYDIYIDVVFGGGTKVEIK |
| CL-33723 | 3482 | EIVLTQSPGTLSLSPGERATLSCERSSGDIWEYYVSWYQQKPGQ APRLLIYADDQRASGIPDRFSGSGSGTDFTLTISRLEPEDFAVY YCQSYDVCIDVVFGGGTKVEIK |
| CL-33725 | 3483 | EIVLTQSPGTLSLSPGERATLSCERSSGDIWEYYVSWYQQKPGQ APRLVIYADDQRPSGIPDRFSGSGSGTDFTLTISRLEPEDFAVY YCQSYDLDIDVVFGGGTKVEIK |
| CL-33726 | 3484 | EIVLTQSPGTLSLSPGERATLSCERSSGSIWYSYVSWYQQKPGQ APRLVIYSDDLRASGIPDRFSGSGSGTDFTLTISRLEPEDFAVY YCQSYDINIDVVFGGGTKVEIK |
| CL-33727 | 3485 | EIVLTQSPGTLSLSPGERATLSCERSSGDIGDSYVSWYQQKPGQ APRLVIYWDDYRASGIPDRFSGSGSGTDFTLTISRLEPEDFAVY YCQSYGIDVDIVFGGGTKVEIK |
| CL-33729 | 3486 | EIVLTQSPGTLSLSPGERATLSCERSSGDIWSYYVSWYQQKPGQ APRLVIYADDQRASGIPDRFSGSGSGTDFTLTISRLEPEDFAVY YCQSYDLDIDITFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-33730 | 3487 | EIVLTQSPGTLSLSPGERATLSCERSSGDIWSYYVSWYQQKPGQ APRLVIYADDQRASGIPDRFSGSGSGTDFTLTISRLEPEDFAVY YCQSYDLNIDTVFGGGTKVEIK |
| CL-33732 | 3488 | EIVLTQSPGTLSLSPGERATLSCERSSCDIWQYYVSWYQQKPGQ APRLLIYADDQRATGIPDRFSGSGSGTDFTLIISRLEPEDFAVY YCQSYDLDIDVVFGGGTKVEIK |
| CL-33733 | 3489 | EIVLTQSPGTLSLSPGERATLSCERSSGDIWEYYVSWYQQKPGQ APRLVIYSDDQRASGIPDRFSGSGSGTDFTLTISRLEPEDFAVY YCQSYDIITDVVFGGGTKVEIK |
| CL-33734 | 3490 | EIVLTQSPGTLSLSPGERATLSCERSSGDIWHTYVSWYQQKPGQ APRLVIYADDQRPTGIPDRFSGSGSGTDFTLTISRLEPEDFAVY YCQSYDVNIDVVFGGGTKVEIK |
| CL-33740 | 3491 | EIVLTQSPGTLSLSPGERATLSCERSSGSIWSTYVSWYQQKPGQ APRLLIYSDDQRATGIPDRFSGSGSGTDFTLTISRLEPEDFAVY YCQSYDVVIDIVFGGGTKVEIK |
| CL-33741 | 3492 | EIVLTQSPGTLSLSPGERATLSCERSSGDIWEYYVSWYQQKPGQ APRLLIYSDDQRASGIPDRFSGSGSGTDFTLTISRLEPEDFAVY YCQSYDLIIDIVFGGGTKVEIK |
| CL-33742 | 3493 | EIVLTQSPGTLSLSPGERATLSCERSSGDIWHYYVSWYQQKPGQ APRLLIYADDQRASGIPDRFSGSGSGTDFTLTISRLEPEDFAVY YCQSYDLDIDVTFGGGTKVEIK |
| CL-33743 | 3494 | EIVLTQSPGTLSLSPGERATLSCERSSGSIWGYYVSWYQQKPGQ APRLVIYADDHRASGIPDRFSGSGSGTDFTLTISRLEPEDFAVY YCQSYDETIDIVFGGGTKVEIK |
| CL-33745 | 3495 | EIVLTQSPGTLSLSPGERATLSCERSSGDIYYTYVSWYQQKPGQ APRLVIYADDQRASGIPDRFSGSGSGTDFTLTISRLEPEDFAVY YCQSYDIDIDITFGGGTKVEIK |
| CL-33746 | 3496 | EIVLTQSPGTLSLSPGERATLSCERSSGDIWQSYVSWYQQKPGQ APRLVIYSDDQRASGIPDRFSGSGSGTDFTLTISRLEPEDFAVY YCQSYDIDVDIVFGGGTKVEIK |
| CL-33747 | 3497 | EIVLTQSPGTLSLSPGERATLSCRASSGSIWYSFVSWYQQKPGQ APRLVIYSDDQRASGIPDRFSGSGSGTDFTLTISRLEPEDFAVY YCQSYGINIDVVFGGGTKVEIK |
| CL-33755 | 3498 | EIVLTQSPGTLSLSPGERATLSCERSSGDIGDSYVSWYQQKPGQ APRLVIYSDDQRATGIPDRFSGSGSGTDFTLTISRLEPEDFAVY YCQSYGTNIDVVFGGGTKVEIK |
| CL-33756 | 3499 | EIVLTQSPGTLSLSPGERATLSCERSSGDIWESYVSWYQQKPGQ APRLVIYADDQRPTGIPDRFSGSGSGTDFTLTISRLEPEDFAVY YCQSYGIIDDIVFGGGTKVEIK |
| CL-33757 | 3500 | EIVLTQSPGTLSLSPGERATLSCERSSGDIWETYVSWYQQKPGQ APRLVIYSDDQRPSGIPDRFSGSGSGTDFTLTISRLEPEDFAVY YCQSYDIDIDVTFGGGTKVEIK |
| CL-33758 | 3501 | EIVLTQSPGTLSLSPGERATLSCERSSGDIWQTYVSWYQQKPGQ APRLVIYADDQRATGIPDRFSGSGSGTDFTLTISRLEPEDFAVY YCQSYDIDIDVVFGGGTKVEIK |
| CL-33760 | 3502 | EIVLTQSPGTLSLSPGERATLSCERSSGDIGDSYVSWYQQKPGQ APRLLIYADDQRASGIPDRFSGSGSGTDFTLTISRLEPEDFAVY YCQSYGLNIDVVFGGGTKVEIK |
| CL-33761 | 3503 | EIVLTQSPGTLSLSPGERATLSCERSSGDIWSYYVSWYQQKPGQ APRLLIYADDQRATGIPDRFSGSGSGTDFTLTISRLEPEDFAVY YCQSYDICIDVTFGGGTKVEIK |
| CL-33763 | 3504 | EIVLTQSPGTLSLSPGERATLSCERSSGDIWEYYVSWYQQKPGQ APRLVIYADDQRASGIPDRFSGSGSGTDFTLTISRLEPEDFAVY YCQSYDIDIDIVFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-33766 | 3505 | EIVLTQSPGTLSLSPGERATLSCERSSGDIYDAYVSWYQQKPGQ APRLVIYADDQRASGIPDRFSGSGSGTDFTLTISRLEPEDFAVY YCQSYDIDVDVVFGGGTKVEIK |
| CL-33768 | 3506 | EIVLTQSPGTLSLSPGERATLSCERSSGSIWDTYVSWYQQKPGQ APRLVIYSDDQRPSGIPDRFSGSGSGTDFTLTISRLEPEDFAVY YCQSYDIDIDVVFGGGTKVEIK |
| CL-33771 | 3507 | EIVLTQSPGTLSLSPGERATLSCERSSGSIWQYYVSWYQQKPGQ APRLLIYADDKRASGIPDRFSGSGSGTDFTLTISRLEPEDFAVY YCQSYDEDIDITFGGGTKVEIK |
| CL-33773 | 3508 | EIVLTQSPGTLSLSPGERATLSCERSSGDIWSYYVSWYQQKPGQ APRLVIYADDQRASGIPDRFSGSGSGTDFTLTISRLEPEDFAVY YCQSYDLNIDVTFGGGTKVEIK |
| CL-33774 | 3509 | EIVLTQSPGTLSLSPGERATLSCERSSGDIWSYYVSWYQQKPGQ APRLLIYADDQRATGIPDRFSGSGSGTDFTLTISRLEPEDFAVY YCQSYDLYIDIVFGGGTKVEIK |
| CL-33775 | 3510 | EIVLTQSPGTLSLSPGERATLSCERSSGDIWQTYVSWYQQKPGQ APRLVIYADDMRASGIPDRFSGSGSGTDFTLTISRLEPEDFAVY YCQSYDLNIDVTFGGGTKVEIK |
| CL-33776 | 3511 | EIVLTQSPGTLSLSPGERATLSCERSSGDIGYSYVSWYQQKPGQ APRLVIYADDQRASGIPDRFSGSGSGTDFTLTISRLEPEDFAVY YCQSYGIIIDIVFGGGTKVEIK |
| CL-33777 | 3512 | EIVLTQSPGTLSLSPGERATLSCERSSGDIYETYVSWYQQKPGQ APRLLIYADDQRPSGIPDRFSGSGSGTDFTLTISRLEPEDFAVY YCQSYDIDIDVVFGGGTKVEIK |
| CL-33778 | 3513 | EIVLTQSPGTLSLSPGERATLSCERSSGDIWEYYVSWYQQKPGQ APRLVIYADDQRASGIPDRFSGSGSGTDFTLTISRLEPEDFAVY YCQSYGLITDVTFGGGTKVEIK |
| CL-33779 | 3514 | EIVLTQSPGTLSLSPGERATLSCERSSGSIWETYVSWYQQKPGQ APRLVIYADDRRPSGIPDRFSGSGSGTDFTLTISRLEPEDFAVY YCQSYGIDIDVVFGGGTKVEIK |
| CL-33781 | 3515 | EIVLTQSPGTLSLSPGERATLSCERSSGDIWEYYVSWYQQKPGQ APRLLIYADDQRASGIPDRFSGSGSGTDFTLTISRLEPEDFAVY YCQSYGIDTDIVFGGGTKVEIK |
| CL-33782 | 3516 | EIVLTQSPGTLSLSPGERATLSCERSSGDIWDTYVSWYQQKPGQ APRLVIYSDDQRASGIPDRFSGSGSGTDFTLTISRLEPEDFAVY YCQSYGINIDVVFGGGTKVEIK |
| CL-33785 | 3517 | EIVLTQSPGTLSLSPGERATLSCERSSGSIWQTYVSWYQQKPGQ APRLVIYSDDQRASGIPDRFSGSGSGTDFTLTISRLEPEDFAVY YCQSYDIVIDVVFGGGTKVEIK |
| CL-33787 | 3518 | EIVLTQSPGTLSLSPGERATLSCERSSGDIWQYYVSWYQQKPGQ APRLVIYADDHRATGIPDRFSGSGSGTDFTLTISRLEPEDFAVY YCQSYDLDIDVTFGGGTKVEIK |
| CL-33790 | 3519 | EIVLTQSPGTLSLSPGERATLSCERSSGDIWHTYVSWYQQKPGQ APRLVIYADDQRATGIPDRFSGSGSGTDFTLTISRLEPEDFAVY YCQSYDVDIDITFGGGTKVEIK |
| CL-33791 | 3520 | EIVLTQSPGTLSLSPGERATLSCERSSGDIWQAYVSWYQQKPGQ APRLVIYSDDQRPSGIPDRFSGSGSGTDFTLTISRLEPEDFAVY YCQSYDIIEDITFGGGTKVEIK |
| CL-33792 | 3521 | EIVLTQSPGTLSLSPGERATLSCERSSGDIYETYVSWYQQKPGQ APRLVIYSDDHRASGIPDRFSGSGSGTDFTLTISRLEPEDFAVY YCQSYGIITDIVFGGGTKVEIK |
| CL-33794 | 3522 | EIVLTQSPGTLSLSPGERATLSCERSSGSIWDYYVSWYQQKPGQ APRLLIYADDQRASGIPDRFSGSGSGTDFTLTISRLEPEDFAVY YCQSYDLITDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-33795 | 3523 | EIVLTQSPGTLSLSPGERATLSCERSSGDIWQTYVSWYQQKPGQ APRLVIYADDQRPSGIPDRFSGSGSGTDFTLTISRLEPEDFAVY YCQSYGINIDVVFGGGTKVEIK |
| CL-33796 | 3524 | EIVLTQSPGTLSLSPGERATLSCERSSGDIWEYYVSWYQQKPGQ APRLLIYADDQRASGIPDRFSGSGSGTDFTLTISRLEPEDFAVY YCQSYDLIRDIVFGGGTKVEIK |
| CL-33799 | 3525 | EIVLTQSPGTLSLSPGERATLSCERSSGSIYETYVSWYQQKPGQ APRLLIYADDWRASGIPDRFSGSGSGTDFTLTISRLEPEDFAVY YCQSYDITVDVVFGGGTKVEIK |
| CL-33801 | 3526 | EIVLTQSPGTLSLSPGERATLSCERSSGDIWESYVSWYQQKPGQ APRLVIYSDDQRPTGIPDRFSGSGSGTDFTLTISRLEPEDFAVY YCQSYGIIDDIVFGGGTKVEIK |
| CL-33802 | 3527 | EIVLTQSPGTLSLSPGERATLSCERSSGDIWEYYVSWYQQKPGQ APRLLIYADDQRASGIPDRFSGSGSGTDFTLTISRLEPEDFAVY YCQSYDLDIDITFGGGTKVEIK |
| CL-33813 | 3528 | EIVLTQSPGTLSLSPGERATLSCERSSGDIWQTYVSWYQQKPGQ APRLVIYADDQRASGIPDRFSGSGSGTDFTLTISRLEPEDFAVY YCQSYGIDIDVVFGGGTKVEIK |
| CL-33814 | 3529 | EIVLTQSPGTLSLSPGERATLSCRASSGSIWYSYVSWYQQKPGQ APRLLIYADDQRASGIPDRFSGSGSGTDFTLTISRLEPEDFAVY YCQSYGINIDVVFGGGTKVEIK |
| CL-33815 | 3530 | EIVLTQSPGTLSLSPGERATLSCERSSGDIYETYVSWYQQKPGQ APRLVIYSDDHRPSGIPDRFSGSGSGTDFTLTISRLEPEDFAVY YCQSYGIDVDVVFGGGTKVEIK |
| CL-33816 | 3531 | EIVLTQSPGTLSLSPGERATLSCERSSGDIYETYVSWYQQKPGQ APRLVIYSDDHRPSGIPDRFSGSGSGTDFTLTISRLEPEDFAVY YCQSYGINVDVVFGGGTKVEIK |
| CL-33817 | 3532 | EIVLTQSPGTLSLSPGERATLSCRASSGDISDKYVSWYQQKPGQ APRLVIYADDYRASGIPDRFSGSGSGTDFTLTISRLEPEDFAVY YCQSYDLCIDVTFGGGTKVEIK |
| CL-33819 | 3533 | EIVLTQSPGTLSLSPGERATLSCRASSGDISDKYVSWYQQKPGQ APRLLIYADDWRASGIPDRFSGSGSGTDFTLTISRLEPEDFAVY YCQSYGIDVDVVFGGGTKVEIK |
| CL-33825 | 3534 | EIVLTQSPGTLSLSPGERATLSCERSSGSIWQYYVSWYQQKPGQ APRLLIYADDQRASGIPDRFSGSGSGTDFTLTISRLEPEDFAVY YCQSYDLDIDVTFGGGTKVEIK |
| CL-33826 | 3535 | EIVLTQSPGTLSLSPGERATLSCERSSGDIWDYYVSWYQQKPGQ APRLVIYSDDQRASGIPDRFSGSGSGTDFTLTISRLEPEDFAVY YCQSYDLEIDVVFGGGTKVEIK |
| CL-33828 | 3536 | EIVLTQSPGTLSLSPGERATLSCERSSGDIWDTYVSWYQQKPGQ APRLLIYADDQRPSGIPDRFSGSGSGTDFTLTISRLEPEDFAVY YCQSYDITVDVVFGGGTKVEIK |
| CL-33829 | 3537 | EIVLTQSPGTLSLSPGERATLSCERSSGSIWYSYVSWYQQKPGQ APRLVIYADDQRASGIPDRFSGSGSGTDFTLTISRLEPEDFAVY YCQSYDIDIDVTFGGGTKVEIK |
| CL-33832 | 3538 | EIVLTQSPGTLSLSPGERATLSCERSSGDIWDYYVSWYQQKPGQ APRLVIYADDQRATGIPDRFSGSGSGTDFTLTISRLEPEDFAVY YCQSYDLIIDVTFGGGTKVEIK |
| CL-33833 | 3539 | EIVLTQSPGTLSLSPGERATLSCERSSGDIWETYVSWYQQKPGQ APRLVIYADDQRATGIPDRFSGSGSGTDFTLTISRLEPEDFAVY YCQSYDIDVDIVFGGGTKVEIK |
| CL-33834 | 3540 | EIVLTQSPGTLSLSPGERATLSCERSSGSIWYSYVSWYQQKPGQ APRLVIYSDDQRASGIPDRFSGSGSGTDFTLTISRLEPEDFAVY YCQSYDIDSDIVFGGGTKVEIK |

TABLE 47-continued

List of Amino Acid Sequences Of Affinity
Matured hBDI-9E8.4 VL Variants

| Clone | SEQ ID NO: | VL |
|---|---|---|
| CL-33836 | 3541 | EIVLTQSPGTLSLSPGERATLSCRASSGSIWYSFVSWYQQKPGQ APRLVIYADDQRATGIPDRFSGSGSGTDFTLTISRLEPEDFAVY YCQSYGINVDIVFGGGTKVEIK |
| CL-33837 | 3542 | EIVLTQSPGTLSLSPGERATLSCERSSGDIYQTYVSWYQQKPGQ APRLVIYADDQRASGIPDRFSGSGSGTDFTLTISRLEPEDFAVY YCQSYGIDIDVVFGGGTKVEIK |
| CL-33839 | 3543 | EIVLTQSPGTLSLSPGERATLSCERSSGSIWETYVSWYQQKPGQ APRLVIYADDQRASGIPDRFSGSGSGTDFTLTISRLEPEDFAVY YCQSYGVDIDVVFGGGTKVEIK |
| CL-33840 | 3544 | EIVLTQSPGTLSLSPGERATLSCERSSGDIYETYVSWYQQKPGQ APRLVIYSDDQRASGIPDRFSGSGSGTDFTLTISRLEPEDFAVY YCQSYDIDIDVVFGGGTKVEIK |
| CL-33841 | 3545 | EIVLTQSPGTLSLSPGERATLSCERSSGSIWQYYVSWYQQKPGQ APRLVIYSDDQRASGIPDRFSGSGSGTDFTLTISRLEPEDFAVY YCQSYDLFIDVTFGGGTKVEIK |
| CL-33844 | 3546 | EIVLTQSPGTLSLSPGERATLSCERSSGDIWDTYVSWYQQKPGQ APRLLIYSDDQRATGIPDRFSGSGSGTDFTLTISRLEPEDFAVY YCQSYGIYVDIVFGGGTKVEIK |
| CL-33847 | 3547 | EIVLTQSPGTLSLSPGERATLSCERSSGSIYYTYVSWYQQKPGQ APRLVIYADDQRASGIPDRFSGSGSGTDFTLTISRLEPEDFAVY YCQSYDIEIDITFGGGTKVEIK |
| CL-33848 | 3548 | EIVLTQSPGTLSLSPGERATLSCERSSGDIYETYVSWYQQKPGQ APRLVIYSDDHRPSGIPDRFSGSGSGTDFTLTISRLEPEDFAVY YCQSYDIDTDIVFGGGTKVEIK |
| CL-33849 | 3549 | EIVLTQSPGTLSLSPGERATLSCERSSGDIWYSYVSWYQQKPGQ APRLVIYSDDQRASGIPDRFSGSGSGTDFTLTISRLEPEDFAVY YCQSYGINIDVVFGGGTKVEIK |
| CL-33854 | 3550 | EIVLTQSPGTLSLSPGERATLSCERSSGDIWHTYVSWYQQKPGQ APRLLIYADDQRATGIPDRFSGSGSGTDFTLTISRLEPEDFAVY YCQSYGINVDVVFGGGTKVEIK |
| CL-33857 | 3551 | EIVLTQSPGTLSLSPGERATLSCERSSGDIWESYVSWYQQKPGQ APRLLIYSDDQRATGIPDRFSGSGSGTDFTLTISRLEPEDFAVY YCQSYGINIDVVFGGGTKVEIK |
| CL-33858 | 3552 | EIVLTQSPGTLSLSPGERATLSCERSSGDIGHTYVSWYQQKPGQ APRLVIYADDQRASGIPDRFSGSGSGTDFTLTISRLEPEDFAVY YCQSYGIISDVVFGGGTKVEIK |
| CL-33862 | 3553 | EIVLTQSPGTLSLSPGERATLSCERSSGSIWGTYVSWYQQKPGQ APRLVIYADDQRATGIPDRFSGSGSGTDFTLTISRLEPEDFAVY YCQSYDIDIDVTFGGGTKVEIK |
| CL-41468 | 3554 | EIVLTQSPGTLSLPPGERATLSCKRSSGSIYDTYVSWYQQKPGQ APRLVIYSDDQRPSGIPDRFSGSGSGTDFTLTISRLEPEDFAVY YCQSYDLTIDITFGGGTKVEIK |
| CL-41469 | 3555 | EIVLTQSPGTLSLSPGERATLSCERSSGSIWHSYVSWYQQKPGQ APRLLIYSDDQRATGIPDRFSGSGSGTDFTLTISRLEPEDFAVY YCQSYGIYIDVVFGGGTRSKLS |
| CL-41472 | 3556 | EIVLTQSPGTLSLSPGERATLSCERSSGDIWDTYVSWYQQKPGQ APRLLIYADDQRPSGIPDRFSGSGSGTDFTLTISRLEPEDFAVY YCQSYDLTIDITFGGGTKVEIK |
| CL-41477 | 3557 | EIVLTQSPGTLSLSPGERATPSCRASSGSIWYSFVSWYQQKPGQ APRLLIYADDQRASGIPDRFSGSGSGTDFTLTISRLEPEDFAVY YCQSYGINIDVVFGGGTKVEIK |
| CL-41479 | 3558 | EIVLTQSPGTLSLSPGERATLSCERSSGDIWDYYVSWYQQKPGQ APRLVIYADDQRPSGIPDRFSGSGSGTDFTLTISRLEPEDFAVY YCQPYDLFIDVTFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-41480 | 3559 | EIVLTQSPGTLSLSPGERATLSCERSSGDIWQSYVSWYQQKPGQ APRLVIYSDDQRASGIPDRFSGSGSGTDFTLTISRLEPEDFAGY YCQSYGINIDVVFGGGTKVEIK |
| CL-41486 | 3560 | EIVLTQSPGTLSLSPGERATLSCERSSGDIGDYYVSWYQQKPGQ APRLVIYADDQRPSGIPDRFSGSGSGTDFTLTISRLEPEDFAVY YCQSYDLFIDVTFGGGTKVEIK |
| CL-41505 | 3561 | EIVLTQSPGTLSLSPGERATLSCERSSGSIWHSYVSWYQQKPGQ APRLLIYSDDQRATGIPDRFSGSGSGTDFTLTISRLEPEDFAVY YCQSYGIETDIVFGGGTKVEIK |
| CL-41509 | 3562 | EIVLTQSPGTWSLSPGERATLSCERSSGSNYDTYVSWYQQKPGQ APRLLIYADDLRASGIPDRFSGSGSGTDFTLTISRLEPEDFAVY YCQSYGIETDIVFGGGTKVEIK |
| CL-41528 | 3563 | EIVLTQSPGTLSLSPGERATLSCERSSGSIWHSYVSWYQQKPGQ APRLLIYSDDQRATGIPDRFSGSGSGTDFTLTISRLEPEDFAVY YCQSYGIYIDVVFGGDTKVEIK |
| CL-41529 | 3564 | EIVLTQSPGTLSLSSGERATLSCERSSGSNYDTYVSWYQQKPGQ APRLLIYADDLRASGIPDRFSGSGSGTDFTLTISRLEPEDFAVY YCQSYGIETDIVFGGGTKVEIK |
| CL-41532 | 3565 | EIVLTQSPGTLSLSPGERATLSCRASSGSTWYSFVSWYQQKPGQ APRLLIYADDQRASGIPDRFSGSGSGTDFTLTISRLEPEDFAVY YCQSYGINIDVVFGGGTKVEIK |
| CL-41535 | 3566 | EIVLTQSPGTLSLSPGERATLSCERSSGDIWDYYVSWYQQKPGQ APRLVIYADDQRPSGIPDRFSGSGSGTDFTLTISRLEPEDFAVY YCQSYDLTIDITFGGGTKVEIK |
| CL-41536 | 3567 | EIVLTQSPGTLSLSPGERATLSCERSSGDIWDYYVSWYQQKPGQ APRLVIYSDDQRPSGIPDRFSGSGSGTDFTLTISRLEPEDFAVY YCQSYDLFIDXTFGGGTKVEIK |
| CL-41539 | 3568 | EIVLTQSPGTLSLSPGERATLSCERSSGDIWDTYVSWYQQKPGQ APRLLIYADDQRPSGIPDRFSGSGSGTDFTLTISRLEPEGFAVY YCQSYDIIIDIVFGGGTKVEIK |
| CL-41543 | 3569 | EIVLTQSPGTLSLSPGERATLSCERSSGDIWDTYVSWYQQKPGQ ASRLLIYADDQRPSGIPDRFSGSGSGTDFTLTISRLEPEDFAVY YCQSYDIIIDIVFGGGTKVEIK |
| CL-41547 | 3570 | EIVLTQSPGTLSLSPGERATLSCERSSGSIWHSYVSWYQQKPGQ APRLLIYSDDQRATGIPDRFSGSGSGTDFTLTISRLEPEDFAVY YCQSYGIYIDVVFGGGTNVEIK |
| CL-41550 | 3571 | EIVLTQSPGTLSLSPGERATLSCKRSSGSIYDTYVSWYQQKPGQ APRLVIYSDDQRPSGIPDRFSGSGSGTDFTLTISRLEPEDFAVY YCQSYDLTIDITFGGGTKVEIK |
| CL-41554 | 3572 | EIVLTQSPGTLSLSPGERATLSCERSSGDIWQSYVSWYQQKPGQ APRLVIYSDDQRASGIPDRFSGSGSGTDFTLTISRLEPEDFAVY YCQSYGINIDVVFGGGTKVEIK |
| CL-41556 | 3573 | EIVLTQSPGTLSLSPGERATLSCERSSGSIWHSYVSWYQQKPGQ APRLLIYSDDQRATGIPDRFSGSGSGTDFTLTISRLEPEDFAVY YCQSYGIYIDVVFGGGTKVEIK |
| CL-41557 | 3574 | EIVLTQSPGTLSLSPGERATLSCERSSGDIWDTYVSWYQQKPGQ APRLLIYADDQRPSGIPDRFSGSGSGTDFTLTISRLEPEDFAVY YCQSYDIIIDIVFGGGTKVEIK |
| CL-41560 | 3575 | EIFLTQSPGTLSLSPGKKATLSGKRSSGSIYNTYFSGYQQKPGQ APKRVIYSDDRRPSGIPDRFSGSGXGTDFTLTISXLEPKDFAVY YCQSYDLTINLXFGGGTKVXIX |
| CL-41561 | 3576 | EIVLTQSPGTLSLSPGERATLSCERSSGSNYDTYVSWYQQKPGQ APRLLIYADDLRASGIPDRFSGSGSGTDFTLTISRLEPEDFAVY YCQSYGIETDIVFGGGTKVEIK |

TABLE 47-continued

List of Amino Acid Sequences Of Affinity
Matured hBDI-9E8.4 VL Variants

| Clone | SEQ ID NO: VL | |
|---|---|---|
| CL-41562 | 3577 | EIVLTQSPGTLSLSPGERATLSCERSSGDIGDSYVSWYQQKPGQ SPRLVIYADDQRPSGIPDRFSGSGSGTDFTLTISRLEPEDFAVY YCQSYDINIDIVFGGGTKVEIK |
| CL-41569 | 3578 | EIVLTQSPGTLSLSPGERATLSCERSSGDIGDSYVSWYQQKPGQ APRLVIYADDQRPRGIPDRFSGSGSGTDFTLTISRLEPEDFAVY YCQSYDINIDIVFGGGTKVEIK |
| CL-41577 | 3579 | EIVLTQSPGTLSLSPGERATLSCERSSGSIWQSYVSWYQQKPGQ APRLVIYADDQRATGIPDRFSGSGSGTDFTLTISRLEPEDFAVY YCQSYDIDIDVVFGGGTKVEIS |
| CL-41581 | 3580 | EIVLTQSPGTLSLSPGERATLSCRASSGSIWYSFVSRYQQKPGQ APRLLIYADDQRASGIPDRFSGSGSGTDFTLTISRLEPEDFAVY YCQSYGINIDVVFGGGTKVEIK |
| CL-41591 | 3581 | EIVLTQSPGTLSLSPGERATLSCRASSGSIWYSFVSWYQQKPGQ APRLLIYADDQRASGIPDRFSGSGSGTDFTLTISRLEPEDFAVY YCQSYGIDIDVVFGGGTKVEIK |
| CL-41599 | 3582 | KSSLTQSPGTLSLSPGERATLSCRASSGSIWYSFVSWYQQKPGQ APRLLIYADDQRASGIPDRFSGSGSGTDFTLTISRLEPEDFAVY YCQSYGINIDVVFGGGTKVEIK |
| CL-41600 | 3583 | EIVLTQSLGTLSLSPGERATLSCRASSGSIWYSFVSWYQQKPGQ APRLLIYADDQRASGIPDRFSGSGSGTDFTLTISRLEPEDFAVY YCQSYGINIDVVFGGGTKVEIK |
| CL-41615 | 3584 | EIVLTQSPGTLSLSPGERATLSCERSSGDIWQMYVSWYQQKPGQ APRLVIYGDDQRASGIPDRFSGSGSGTDFTLTISRLEPEDFAVY YCQSYDIDIDITFGGGTKVEIK |
| CL-41616 | 3585 | EIVLTQSPGTLSLPPGERATLSCERSSGDIWQTYVSWYQQKPGQ APRLVIYGDDQRASGIPDRFSGSGSGTDFTLTISRLEPEDFAVY YCQSYDIDIDITFGGGHKGRNX |
| CL-41639 | 3586 | EIVLTQSPGTLSLSPGERATLSCERSSGDIWDYYVSWYQQKPGQ APRLVIYADDQRPSGIPDRFSGSGSGTDFTLTISRLEPEDSAVY YCQSYDLFIDVTFGGGTKVEIK |
| CL-41642 | 3587 | EIVLTQSPGTLSLSPGERATLSCERSSGDIWDYYVSWYQRKPGQ APRLVIYADDQRPSGIPDRFSGSGSGTDFTLTISRLEPEDFAVY YCQSYGINIDVVFGGGTKVEIK |
| CL-41645 | 3588 | EIVLTQSPGTLSLSPGERATLSCERSSGDIWQTYVSWYQQKPGQ APRLVIYGDDQRASGIPDRFSGSGSGTDFTLTISRLEPEDFAVY YCQSYDIDIDITFGGGTKVEIK |
| CL-41646 | 3589 | EIVLTQSPGTLSLSPGERATLSCERSSGSIWQSYVSWYQQKPGQ APRLVIYADDQRATGIPDRFSGSGSGTDFTLTISRLEPEDFAVY YCQSYDIDIDVVFGGGTKVEIK |
| CL-41649 | 3590 | EIVLTQSPGTLSLSPGERATLSCERSSGDIWDYYVSWYQQKPGQ APRLVIYADDQRPSGIPDRFSGSGSGTDFTLTISRLEPEDFAVY YCQSYDLFIDVTFGGGTKVEIK |
| CL-41654 | 3591 | EIVLTQSPGTLSLSPGERATLSCRASSGSIWYSFVSWYQQKPGQ APRLLIYADDQRASGIPDRFSGSGSGTDFTLTISRLEPEDFAVH YCQSYGINIDVVFGGGTKVEIK |
| CL-41655 | 3592 | EIVLTQSPGTLSLSPGERATLSCERSSGDIWQTYVSWYQQKPGQ APRLVIYGDDQRASGIPDRFSGSGSGTDFTLTISRLEPEDFAVY YCQSYGINIDVVFGGGTKVEIK |
| CL-41668 | 3593 | EIVLTQSPGTLSLSPGERATLSCRASSGSIWYSFVSWYQQKPGQ APRLLIYADDQRASGIPDRFSGSGSGTDFTLTISRLEPEDFAVC YCQSYGINIDVVFGGGTKVEIK |
| CL-41673 | 3594 | EIVLTQSPGTLSLSPGERAPLSCERSSGDIGDSYVSWYQQKPGQ APRLVIYADDQRPSGIPDRFSGSGSGTDFTLTISRLEPEDFAVY YCQSYDINIDIVFGGGTKVEIX |

TABLE 47-continued

List of Amino Acid Sequences Of Affinity
Matured hBDI-9E8.4 VL Variants

| Clone | SEQ ID NO: VL | |
|---|---|---|
| CL-41685 | 3595 | EIVLTQSPGTLSLSPGERATLSCERSSGDIGDSYVSWYQQKPGQ<br>APRLVIYADDQRPSGIPDRFSGSGSGTDFTLTINRLEPEDFAVY<br>YCQSYDINIDIVFGGGTKVEIK |
| CL-41705 | 3596 | EIVLTQSPGTLSLSPGERATLSCRASSGSIWYSFVSWYQQKPGQ<br>APRLLIYADDQRASGIPDRLSGSGSGTDFTLTISRLEPEDFAVY<br>YCQSYGINIDVVFGGGTKVEIK |
| CL-41707 | 3597 | EIVLTQSPGTLSLSPGERATLSCERSSGDIGDSYVSWYQQKPGQ<br>APRLVIYADGQRPSGIPDRFSGSGSGTDFTLTISRLEPEDFAVY<br>YCQSYDINIDIVFGGGTKVEIK |
| CL-41710 | 3598 | EIVLTQSPSTLSLSPGERATLSCERSSGDIGDSYVSWYQQKPGQ<br>APRLVIYADDQRPSGIPDRFSGSGSGTDFTLTISRLEPEDFAVY<br>YCQSYDINIDIVFGGGTKVEIK |
| CL-41713 | 3599 | EIVLTQSPGTLSLSPGERATLSCRASSGSIWYSFVSWYQQKPGQ<br>APRLLIYADDQRASGIPDRFSGSGSGTDFTLTISRLEPEDFAVY<br>YCQSYGINIDVVFGGGTKVEIN |
| CL-41714 | 3600 | EIVLTQSPGTLSLSPGERATLSCERSSGDIGDSYVSWYQQKPGQ<br>APRLVIYADDQRPSGIPDRFSGSGSGTDFTLTISRLEPEDFAVY<br>YCQSYDINIDIVFGGGTKVELS |
| CL-41720 | 3601 | EIVLTQIPGTLSLSPGERATLSCERSSGDIGDSYVSWYQQKPGQ<br>APRLVIYADDQRPSGIPDRFSGSGSGTDFTLTISRLEPEDFAVY<br>YCQSYDINIDIVFGGGTKVEIK |
| CL-41725 | 3602 | EIVLTQSPGTLSLSPGERATLSCERSSGSNYDTYVSWYQQKPGQ<br>APRLLIYADDLRASGIPDRFSGSGSGTDFTLTISRLEPEDFAVY<br>YCQSYGINIDVVFGGGTKVEIK |
| CL-41727 | 3603 | EIVLTQSPGTLSLSPGERATLSCRASSGSIWYSFVSWYQQKPGQ<br>APRLLIYADDQRASGIPDRFSGSGSGTDFTLTISRLEPEDFAVY<br>YRQSYGINIDVVFGGGTKVEIK |
| CL-41729 | 3604 | EIVLTQSPGTLSLSPGERATLSCRASSGSIWYSFVSWYQQKPGQ<br>APRLLIYADDQRASGIPDRFSGSGSGTDFTLTISRLEPEDFAVY<br>YCQSYGINIDVVFGGGTKVEIK |
| CL-41732 | 3605 | EIVLTQSPGTLSLSPGERATLSCERSSGDIGDSYVSWYQQKPGQ<br>APRLVIYADDQRPIGIPDRFSGSGSGTDFTLTISRLEPEDFAVY<br>YCQSYDINIDIVFGGGTKVEIK |
| CL-41735 | 3606 | EIVLTQSPGTLSLSPVERATLSCERSSGDIGDSYVSWYQQKPGQ<br>APRLVIYADDQRPSGIPDRFSGSGSGTDFTLTISRLEPEDFAVY<br>YCQSYDINIDIVFGGGTKVEIK |
| CL-41737 | 3607 | EIVLTQSPGTLSLSPGERATLSCERSSGDIGDSYVSWYQQKPGQ<br>APRLVIYADDQRPSGIPDRFSGSGSGTDFTLTISRLEPEDFAVY<br>YCQSYDINIDIVFGGGTKVEIK |
| CL-41738 | 3608 | EIVLTQSPATLSLSPGERATLSCRASQSVSTHMHWYQQKPGQAP<br>RLLIYGASNLESGIPARFSGSGSGTDFTLTISSLEPEDFAVYYC<br>QQSWYDPLTFGQGTKLEIK |
| CL-41739 | 3609 | EIVLTQSPATLSLSPGERAALSCRASQSVSTHMHWYQQKPGQAP<br>RLLIYGASNLESGIPARFSGSGSGTDFTLTISSLEPEDFAVYYC<br>QQSWYDPLTFGQGTKLEIK |
| CL-41740 | 3610 | EIVLTQSPATLSLSPGERATLSCRASQSVSTHMHWYQQKPGQAP<br>RLLIYGASNLESGIPARFSGSGSGTDFTLTISSLEPEDFAVYYC<br>QQSRYDPLTFGQGTKLEIK |
| CL-41742 | 3611 | EIVLTQSPGTLSLSPGERATLSCRASQSVSTHMHWYQQKPGQAP<br>RLLIYGASNLESGIPARFSGSGSGTDFTLTISSLEPEDFAVYYC<br>QQSWYDPLTFGQGTKLEIK |
| CL-41751 | 3612 | AKLCXPVPATLSLSPGERATLSCRASQSVSTHMHWYQQKPGQAP<br>RLLIYGASNLESGIPARFSGSGSGTDFTLTISSLEPEDFAVYYC<br>QQSWYDPLTFGQGTKLEIK |

TABLE 47-continued

List of Amino Acid Sequences Of Affinity Matured hBDI-9E8.4 VL Variants

| Clone | SEQ ID NO: | VL |
|---|---|---|
| CL-41752 | 3613 | EIVLTQSPATLSLSPGERATLSCRASQSVSTHMHWYQQKPGQAP RLLIYGASNLESGIPARFSGSGSGTDFTLTISSLEPEDFAVYYC QQSWYDPLTFGQGTKLRSN |

TABLE 48

Amino Acid Residues Found In Each Position Of The Heavy Chain Variable Region During The Affinity Maturation Of Anti-PDGF-BB Antibody hBDI-9E8.4
hBDI-9E8.4-2I|CL-22843 Heavy Chain Variable Region SEQ ID NO: Sequence

```
3614            1          2          3          4          5          6
       1234567890123456789012345678901234567890123456789012345678901234567890
       EVTLRESGPALVKPTQTLTLTCTFSGFSLSTYGMGVGWIRQPPGKALEWLANIWWDDDKY
                              I Y SEVSIDL             L DCYGEEH
                              R A    R L              C NNGTC
                                D    A                G HHVID
                                T    C                V AQN
                                M    V                E HVS
                                R    Y                I YNA
                                L    R                P NRF
                                C    T                A QYG
                                F    E                C SL
                                W    S                G LM
                                P                       C 7          8          9         10         11         12
       123456789012345678901234567890123456789012345678901234567890123456789012
       YNPSLKNRLTISKDTSKNQVVLTMTNMDPVDTATYYCARIESIGTTYSFDYWGQGTMVTVSS
       SL     NS                              LYQTGWPN    E   Y
        T      T                              NVASPWS     D
                                              LKYMFRK     Y
                                              MYWVCIR     A
                                              VLPLYFM     C
                                              RDLFAAA     N
                                              KGVNEME     M
                                              FAEDLYI     W
                                              CMKHVSV     T
                                              TRFYSLL     Q
                                              ESCTDGW     G
                                                RRDP      I
                                              Q KQ        L
                                              K V         P
                                              E N
                                              P E
```

TABLE 49

Amino Acid Residues Found In Each Position Of The Light Chain Variable Region During The Affinity Maturation Of Anti-PDGF Antibody hBDI-9E8.4
hBDI-9E8.4-2I|CL-22843 Light Chain Variable Region SEQ ID NO: Sequence

```
3615            1          2          3          4          5          6
       1234567890123456789012345678901234567890123456789012345678901234567890
       EIVLTQSPGTLSLSPGERATLSCERSSGDIGDSYVSWYQQKPGQAPRLVIYADDQRPSGI
       F                      RAY CSNWYTFFPR   R        MHGYGLQAIR
                              KE  VYTYQYLS G            SA  RP  T
                               S  MSNMR                 WV  H   R
                                  MHKH                  T   W   G
                                  HGAN                  L   Y
                                  DECC                  V   M
                                  RSFA                  F   K
                                  EKLD                  N   D
                                  NFES                  P   A
```

TABLE 49-continued

Amino Acid Residues Found In Each Position Of The Light Chain
Variable Region During The Affinity Maturation
Of Anti-PDGF Antibody hBDI-9E8.4
hBDI-9E8.4-2I|CL-22843 Light Chain Variable Region SEQ ID NO: Sequence

```
                           CRWT                E    E
                           ALD                 D    N
                           LCP                      V
                           VAG                      S
                           FP                       F
                           T                        P
                           Q
                           K 7         8         9         10        11
         1234567890123456789012345678901234567890123456789 0
         PDRFSGSGSGTDFTLTISRLEFEDFAVYYCQSYDINIDIVFGGGTKVEIK
                                       RKP GLFTNVT
                                       Q   VDSPL
                                       H   EEVAG
                                           TTDYT
                                           SIRGS
                                           QYEHN
                                           RCMEF
                                           NVLVA
                                           KSPLH
                                           GRFQR
                                           AANTQ
                                           CLK
                                           FG
                                           H
                                           K
```

TABLE 50

Variable Region Sequences of h9E8.4 Affinity
Matured Clones Converted to IgG

| SEQ ID NO: | Clone | Protein Region | V Region 123456789012345678901234567890 |
|---|---|---|---|
| 3616 | CL-33578 | VH | EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSGWTNYEFDYWGQGTMVTVSS |
| 3617 | CL-33578 | CDR-H1 | GFSLSTYGMGVG |
| 3618 | CL-33578 | CDR-H2 | NIWWDDDKYYNPSLKN |
| 3619 | CL-33578 | CDR-H3 | IQSGWTNYEFDY |
| 3620 | CL-33578 | VL | EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK |
| 3621 | CL-33578 | CDR-L1 | ERSSGDIGDSYVS |
| 3622 | CL-33578 | CDR-L2 | ADDQRPS |
| 3623 | CL-33578 | CDR-L3 | QSYDINIDIV |
| 3624 | CL-33587 | VH | EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSMWTRYDFDYWGQGTMVTVSS |
| 3625 | CL-33587 | CDR-H1 | GFSLSTYGMGVG |
| 3626 | CL-33587 | CDR-H2 | NIWWDDDKYYNPSLKN |

TABLE 50-continued

Variable Region Sequences of h9E8.4 Affinity
Matured Clones Converted to IgG

| SEQ ID NO: | Clone | Protein Region | V Region 12345678901234567890123456789 0 |
|---|---|---|---|
| 3627 | CL-33587 | CDR-H3 | IQSMWTRYDFDY |
| 3628 | CL-33587 | VL | EIVLTQSPGTLSLSPGERATLSCERS SGDIGDSYVSWYQQKPGQAPRLVIYA DDQRPSGIPDRFSGSGSGTDFTLTIS RLEPEDFAVYYCQSYDINIDIVFGGG TKVEIK |
| 3629 | CL-33587 | CDR-L1 | ERSSGDIGDSYVS |
| 3630 | CL-33587 | CDR-L2 | ADDQRPS |
| 3631 | CL-33587 | CDR-L3 | QSYDINIDIV |
| 3632 | CL-33675 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESSG PKYSFDYWGQGTMVTVSS |
| 3633 | CL-33675 | CDR-H1 | GFSLSTYGMGVG |
| 3634 | CL-33675 | CDR-H2 | NIWWDDDKYYNPSLKN |
| 3635 | CL-33675 | CDR-H3 | IESSGPKYSFDY |
| 3636 | CL-33675 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3637 | CL-33675 | CDR-L1 | RASSGSIWYSFVS |
| 3638 | CL-33675 | CDR-L2 | ADDQRAS |
| 3639 | CL-33675 | CDR-L3 | QSYGINIDVV |
| 3640 | CL-33682 | VH | EVTLRESGPALVKPTQTLTLTCTFSG FSLSTYGMGVGWIRQPPGKALEWLAN IWWDDDKYYNPSLKNRLTIKDTSKN QVVLTMTNMDPVDTATYYCARIESSW TSYSFDYWGQGTMVTVSS |
| 3641 | CL-33682 | CDR-H1 | GFSLSTYGMGVG |
| 3642 | CL-33682 | CDR-H2 | NIWWDDDKYYNPSLKN |
| 3643 | CL-33682 | CDR-H3 | IESSWTSYSFDY |
| 3644 | CL-33682 | VL | EIVLTQSPGTLSLSPGERATLSCERS SGSNYDTYVSWYQQKPGQAPRLLIYA DDLRASGIPDRFSGSGSGTDFTLTIS RLEPEDFAVYYCQSYGINIDVVFGGG TKVEIK |
| 3645 | CL-33682 | CDR-L1 | ERSSGSNYDTYVS |
| 3646 | CL-33682 | CDR-L2 | ADDLRAS |
| 3647 | CL-33682 | CDR-L3 | QSYGINIDVV |
| 3648 | CL-33683 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIETIG PKYSFDYWGQGTMVTVSS |
| 3649 | CL-33683 | CDR-H1 | GFSLSTYGMGVG |
| 3650 | CL-33683 | CDR-H2 | NIWWDDDKYYNPSLKN |
| 3651 | CL-33683 | CDR-H3 | IETIGPKYSFDY |

TABLE 50-continued

Variable Region Sequences of h9E8.4 Affinity Matured Clones Converted to IgG

| SEQ ID NO: | Clone | Protein Region | V Region 12345678901234567890123456789 0 |
|---|---|---|---|
| 3652 | CL-33683 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3653 | CL-33683 | CDR-L1 | RASSGSIWYSFVS |
| 3654 | CL-33683 | CDR-L2 | ADDQRAS |
| 3655 | CL-33683 | CDR-L3 | QSYGINIDVV |
| 3656 | CL-33699 | VH | EVTLRESGPALVKPTQTLTLTCTFSG FSLSTYGMGIGWIRQPPGKALEWLAN IWWDDDKYYNPSLKNRLTISKDTSKN QVVLTMTNMDPVDTATYYCARIESMG PKYAFDYWGQGTMVTVSS |
| 3657 | CL-33699 | CDR-H1 | GFSLSTYGMGIG |
| 3658 | CL-33699 | CDR-H2 | NIWWDDDKYYNPSLKN |
| 3659 | CL-33699 | CDR-H3 | IESMGPKYAFDY |
| 3660 | CL-33699 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3661 | CL-33699 | CDR-L1 | RASSGSIWYSFVS |
| 3662 | CL-33699 | CDR-L2 | ADDQRAS |
| 3663 | CL-33699 | CDR-L3 | QSYGINIDVV |
| 3664 | CL-33701 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESLG TSYSFDYWGQGTMVTVSS |
| 3665 | CL-33701 | CDR-H1 | GFSLSTYGMGVG |
| 3666 | CL-33701 | CDR-H2 | NIWWDDDKYYNPSLKN |
| 3667 | CL-33701 | CDR-H3 | IESLGTSYSFDY |
| 3668 | CL-33701 | VL | EIVLTQSPGTLSLSPGERATLSCERS SGDIWDYYVSWYQQKPGQAPRLVIYA DDQRPSGIPDRFSGSGSGTDFTLTIS RLEPEDFAVYYCQSYDLFIDVTFGGG TKVEIK |
| 3669 | CL-33701 | CDR-L1 | ERSSGDIWDYYVS |
| 3670 | CL-33701 | CDR-L2 | ADDQRPS |
| 3671 | CL-33701 | CDR-L3 | QSYDLFIDVT |
| 3672 | CL-33706 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIETMG PKYSFDYWGQGTMVTVSS |
| 3673 | CL-33706 | CDR-H1 | GFSLSTYGMGVG |
| 3674 | CL-33706 | CDR-H2 | NIWWDDDKYYNPSLKN |
| 3675 | CL-33706 | CDR-H3 | IETMGPKYSFDY |

TABLE 50-continued

Variable Region Sequences of h9E8.4 Affinity
Matured Clones Converted to IgG

| SEQ ID NO: | Clone | Protein Region | V Region 12345678901234567890123456789 |
|---|---|---|---|
| 3676 | CL-33706 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3677 | CL-33706 | CDR-L1 | RASSGSIWYSFVS |
| 3678 | CL-33706 | CDR-L2 | ADDQRAS |
| 3679 | CL-33706 | CDR-L3 | QSYGINIDVV |
| 3680 | CL-33731 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESIP TSYSFDYWGQGTMVTVSS |
| 3681 | CL-33731 | CDR-H1 | GFSLSTYGMGVG |
| 3682 | CL-33731 | CDR-H2 | NIWWDDDKYYNPSLKN |
| 3683 | CL-33731 | CDR-H3 | IESIPTSYSFDY |
| 3684 | CL-33731 | VL | EIVLTQSPGTLSLSPGERATLSCERS SGSIWQSYVSWYQQKPGQAPRLVIYA DDQRATGIPDRFSGSGSGTDFTLTIS RLEPEDFAVYYCQSYDIDIDVVFGGG TKVEIK |
| 3685 | CL-33731 | CDR-L1 | ERSSGSIWQSYVS |
| 3686 | CL-33731 | CDR-L2 | ADDQRAT |
| 3687 | CL-33731 | CDR-L3 | QSYDIDIDVV |
| 3688 | CL-33737 | VH | EVTLRESGPALVKPTQTLTLTCTFSG FSLSTYGMGVGWIRKPPGKALEWLAN IWWDDDKYYNPSLKNRLTISKDTSKN QVVLTMTNMDPVDTATYYCARIESSG PKYSFDYWGQGTMVTVSS |
| 3689 | CL-33737 | CDR-H1 | GFSLSTYGMGVG |
| 3690 | CL-33737 | CDR-H2 | NIWWDDDKYYNPSLKN |
| 3691 | CL-33737 | CDR-H3 | IESSGPKYSFDY |
| 3692 | CL-33737 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3693 | CL-33737 | CDR-L1 | RASSGSIWYSFVS |
| 3694 | CL-33737 | CDR-L2 | ADDQRAS |
| 3695 | CL-33737 | CDR-L3 | QSYGINIDVV |
| 3696 | CL-33759 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESVW TRYDFDYWGQGTMVTVSS |
| 3697 | CL-33759 | CDR-H1 | GFSLSTYGMGVG |
| 3698 | CL-33759 | CDR-H2 | NIWWDDDKYYNPSLKN |
| 3699 | CL-33759 | CDR-H3 | IESVWTRYDFDY |

TABLE 50-continued

Variable Region Sequences of h9E8.4 Affinity Matured Clones Converted to IgG

| SEQ ID NO: | Clone | Protein Region | V Region 12345678901234567890123456789 |
|---|---|---|---|
| 3700 | CL-33759 | VL | EIVLTQSPGTLSLSPGERATLSCERS SGDIWQTYVSWYQQKPGQAPRLVIYG DDQRASGIPDRFSGSGSGTDFTLTIS RLEPEDFAVYYCQSYDIDIDITFGGG TKVEIK |
| 3701 | CL-33759 | CDR-L1 | ERSSGDIWQTYVS |
| 3702 | CL-33759 | CDR-L2 | GDDQRAS |
| 3703 | CL-33759 | CDR-L3 | QSYDIDIDIT |
| 3704 | CL-33767 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESIG PKYSFDYWGQGTMVTVSS |
| 3705 | CL-33767 | CDR-H1 | GFSLSTYGMGVG |
| 3706 | CL-33767 | CDR-H2 | NIWWDDDKYYNPSLKN |
| 3707 | CL-33767 | CDR-H3 | IESIGPKYSFDY |
| 3708 | CL-33767 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3709 | CL-33767 | CDR-L1 | RASSGSIWYSFVS |
| 3710 | CL-33767 | CDR-L2 | ADDQRAS |
| 3711 | CL-33767 | CDR-L3 | QSYGINIDVV |
| 3712 | CL-33769 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESIG PKYSFDYWGQGTMVTVSS |
| 3713 | CL-33769 | CDR-H1 | GFSLSTYGMGVG |
| 3714 | CL-33769 | CDR-H2 | NIWWDDDKYYNPSLKN |
| 3715 | CL-33769 | CDR-H3 | IESIGPKYSFDY |
| 3716 | CL-33769 | VL | EIVLTQSPGTLSLSPGERATLSCRAS SGSIWYSFVSWYQQKPGQAPRLLIYA DDQRASGIPDRFSGSGSGTDFTLTIS RLEPEDFAVYYCQSYGINIDVVFGGG TKVEIK |
| 3717 | CL-33769 | CDR-L1 | RASSGSIWYSFVS |
| 3718 | CL-33769 | CDR-L2 | ADDQRAS |
| 3719 | CL-33769 | CDR-L3 | QSYGINIDVV |
| 3720 | CL-33797 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESLG WSYSFDYWGQGTMVTVSS |
| 3721 | CL-33797 | CDR-H1 | GFSLSTYGMGVG |
| 3722 | CL-33797 | CDR-H2 | NIWWDDDKYYNPSLKN |
| 3723 | CL-33797 | CDR-H3 | IESLGWSYSFDY |

TABLE 50-continued

Variable Region Sequences of h9E8.4 Affinity
Matured Clones Converted to IgG

| SEQ ID NO: | Clone | Protein Region | V Region 123456789012345678901234567890 |
|---|---|---|---|
| 3724 | CL-33797 | VL | EIVLTQSPGTLSLSPGERATLSCERS SGDIWDYYVSWYQQKPGQAPRLVIYA DDQRPSGIPDRFSGSGSGTDFTLTIS RLEPEDFAVYYCQSYDLFIDVTFGGG TKVEIK |
| 3725 | CL-33797 | CDR-L1 | ERSSGDIWDYYVS |
| 3726 | CL-33797 | CDR-L2 | ADDQRPS |
| 3727 | CL-33797 | CDR-L3 | QSYDLFIDVT |
| 3728 | CL-33803 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESLP TSYSFDYWGQGTMVTVSS |
| 3729 | CL-33803 | CDR-H1 | GFSLSTYGMGVG |
| 3730 | CL-33803 | CDR-H2 | NIWWDDDKYYNPSLKN |
| 3731 | CL-33803 | CDR-H3 | IESLPTSYSFDY |
| 3732 | CL-33803 | VL | EIVLTQSPGTLSLSPGERATLSCERS SGDIWDTYVSWYQQKPGQAPRLLIYA DDQRPSGIPDRFSGSGSGTDFTLTIS RLEPEDFAVYYCQSYDIIIDIVFGGG TKVEIK |
| 3733 | CL-33803 | CDR-L1 | ERSSGDIWDTYVS |
| 3734 | CL-33803 | CDR-L2 | ADDQRPS |
| 3735 | CL-33803 | CDR-L3 | QSYDIIIDIV |
| 3736 | CL-33805 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESHW WSYAFDYWGQGTMVTVSS |
| 3737 | CL-33805 | CDR-H1 | GFSLSTYGMGVG |
| 3738 | CL-33805 | CDR-H2 | NIWWDDDKYYNPSLKN |
| 3739 | CL-33805 | CDR-H3 | IESHWWSYAFDY |
| 3740 | CL-33805 | VL | EIVLTQSPGTLSLSPGERATLSCERS SGSNYDTYVSWYQQKPGQAPRLLIYA DDLRASGIPDRFSGSGSGTDFTLTIS RLEPEDFAVYYCQSYGIETDIVFGGG TKVEIK |
| 3741 | CL-33805 | CDR-L1 | ERSSGSNYDTYVS |
| 3742 | CL-33805 | CDR-L2 | ADDLRAS |
| 3743 | CL-33805 | CDR-L3 | QSYGIETDIV |
| 3744 | CL-33811 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESSW TTYSFDYWGQGTMVTVSS |
| 3745 | CL-33811 | CDR-H1 | GFSLSTYGMGVG |
| 3746 | CL-33811 | CDR-H2 | NIWWDDDKYYNPSLKN |
| 3747 | CL-33811 | CDR-H3 | IESSWTTYSFDY |

TABLE 50-continued

Variable Region Sequences of h9E8.4 Affinity
Matured Clones Converted to IgG

| SEQ ID NO: | Clone | Protein Region | V Region 12345678901234567890123456789 0 |
|---|---|---|---|
| 3748 | CL-33811 | VL | EIVLTQSPGTLSLSPGERATLSCERS SGSIWHSYVSWYQQKPGQAPRLLIYS DDQRATGIPDRFSGSGSGTDFTLTIS RLEPEDFAVYYCQSYGIYIDVVFGGG TKVEIK |
| 3749 | CL-33811 | CDR-L1 | ERSSGSIWHSYVS |
| 3750 | CL-33811 | CDR-L2 | SDDQRAT |
| 3751 | CL-33811 | CDR-L3 | QSYGIYIDVV |
| 3752 | CL-33812 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESNP WKYSFDYWGQGTMVTVSS |
| 3753 | CL-33812 | CDR-H1 | GFSLSTYGMGVG |
| 3754 | CL-33812 | CDR-H2 | NIWWDDDKYYNPSLKN |
| 3755 | CL-33812 | CDR-H3 | IESNPWKYSFDY |
| 3756 | CL-33812 | VL | EIVLTQSPGTLSLSPGERATLSCERS SGDIWQSYVSWYQQKPGQAPRLVIYS DDQRASGIPDRFSGSGSGTDFTLTIS RLEPEDFAVYYCQSYGINIDVVFGGG TKVEIK |
| 3757 | CL-33812 | CDR-L1 | ERSSGDIWQSYVS |
| 3758 | CL-33812 | CDR-L2 | SDDQRAS |
| 3759 | CL-33812 | CDR-L3 | QSYGINIDVV |
| 3760 | CL-33820 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIESSF TSYSFDYWGQGTMVTVSS |
| 3761 | CL-33820 | CDR-H1 | GFSLSTYGMGVG |
| 3762 | CL-33820 | CDR-H2 | NIWWDDDKYYNPSLKN |
| 3763 | CL-33820 | CDR-H3 | IESSFTSYSFDY |
| 3764 | CL-33820 | VL | EIVLTQSPGTLSLSPGERATLSCKRS SGSIYDTYVSWYQQKPGQAPRLVIYS DDQRPSGIPDRFSGSGSGTDFTLTIS RLEPEDFAVYYCQSYDLTIDITFGGG TKVEIK |
| 3765 | CL-33820 | CDR-L1 | KRSSGSIYDTYVS |
| 3766 | CL-33820 | CDR-L2 | SDDQRPS |
| 3767 | CL-33820 | CDR-L3 | QSYDLTIDIT |
| 3768 | CL-33845 | VH | EVTLRESGPALVKPTQTLTLTCTFSG FSLSTYGMGVGWIRQPPGKALEWLAN IWWDDDKYYNPSLKNRLTISKDTSKN QVVLTMTNMDPVDTATYYCARIVSDW TTYSFDYWGQGTMVTVSS |
| 3769 | CL-33845 | CDR-H1 | GFSLSTYGMGVG |
| 3770 | CL-33845 | CDR-H2 | NIWWDDDKYYNPSLKN |
| 3771 | CL-33845 | CDR-H3 | IVSDWTTYSFDY |

TABLE 50-continued

Variable Region Sequences of h9E8.4 Affinity Matured Clones Converted to IgG

| SEQ ID NO: | Clone | Protein Region | V Region 123456789012345678901234567890 |
|---|---|---|---|
| 3772 | CL-33845 | VL | EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIK |
| 3773 | CL-33845 | CDR-L1 | RASSGSIWYSFVS |
| 3774 | CL-33845 | CDR-L2 | ADDQRAS |
| 3775 | CL-33845 | CDR-L3 | QSYGINIDVV |
| 3776 | CL-33855 | VH | EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETFGPKYSFDYWGQGTMVTVSS |
| 3777 | CL-33855 | CDR-H1 | GFSLSTYGMGVG |
| 3778 | CL-33855 | CDR-H2 | NIWWDDDKYYNPSLKN |
| 3779 | CL-33855 | CDR-H3 | IETFGPKYSFDY |
| 3780 | CL-33855 | VL | EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIK |
| 3781 | CL-33855 | CDR-L1 | RASSGSIWYSFVS |
| 3782 | CL-33855 | CDR-L2 | ADDQRAS |
| 3783 | CL-33855 | CDR-L3 | QSYGINIDVV |

TABLE 51

Summary of Protein Expression And Purification Of Affinity Matured Humanized Anti-Human PDGF-BB Antibodies

| Name | Octet Titer (mg/L)[1] | ~Yield (mg/L)[2] | SEC (% monomer)[3] |
|---|---|---|---|
| CL-33578-IgG | 176.5 | 98.9 | 91.3 |
| CL-33587-IgG | 155.7 | 109.1 | 94.2 |
| CL-33675-IgG | 275.2 | 57.7 | 96.9 |
| CL-33682-IgG | 203.6 | 80.7 | 94.6 |
| CL-33683-IgG | 136.7 | 24.5 | 48.1 |
| CL-33701-IgG | 114.9 | 79.2 | 97.9 |
| CL-33706-IgG | 169.8 | 25.8 | 100.0 |
| CL-33731-IgG | 137.0 | 73.6 | 95.8 |
| CL-33803-IgG | 98.0 | 50.5 | 96.7 |
| CL-33805-IgG | 227.5 | 66.5 | 97.9 |
| CL-33811-IgG | 190.2 | 31.7 | 99.0 |
| CL-33812-IgG | 171.0 | 76.4 | 96.7 |
| CL-33820-IgG | 135.3 | 75.0 | 95.7 |
| CL-33855-IgG | 50.9 | 13.8 | 94.3 |
| CL-33699-IgG | ND | 10.5 | 81.7 |
| CL-33737-IgG | ND | 5.0 | 88.0 |
| CL-33759-IgG | ND | 18.5 | 100.0 |
| CL-33767-IgG | ND | 16.5 | 50.9 |
| CL-33845-IgG | ND | 0.8 | 60.6 |

ND = Not Determined
[1] Octet titer is the amount of IgG in the unpurified supernatant as determined by protein A binding compared to a standard curve using an Octet instrument.
[2] Yield is determined by the total amount of purified protein in mg divided by the total cell culture volume in liters.
[3] SEC % monomer is determined using HPLC size exclusion chromatography.

TABLE 52

Biacore Binding of Affinity-Matured Humanized Anti-PDGF Antibodies

| Antibody | $k_{on}$ (M-1 s-1) | $k_{off}$ (M-1) | $K_D$ (M) |
|---|---|---|---|
| CL-33578 | ≥9.0E+07 | 2.70E-05 | ≤3.0E-13 |
| CL-33587 | ≥9.0E+07 | 2.00E-05 | ≤2.2E-13 |
| CL-33675 | 3.60E+07 | 2.20E-05 | 6.10E-13 |
| CL-33682 | ≥9.0E+07 | 2.20E-05 | ≤2.4E-13 |
| CL-33683 | 1.90E+07 | 8.20E-06 | 4.40E-13 |
| CL-33701 | 7.30E+07 | 1.80E-05 | 2.40E-13 |
| CL-33706 | 1.80E+07 | 1.20E-05 | 6.90E-13 |
| CL-33731 | 8.10E+07 | 1.60E-05 | 2.00E-13 |
| CL-33803 | ≥9.0E+07 | 1.40E-05 | ≤1.6E-13 |
| CL-33805 | 6.80E+07 | 1.50E-05 | 2.10E-13 |
| CL-33811 | 2.70E+07 | 1.20E-05 | 4.50E-13 |
| CL-33812 | 6.30E+07 | 1.90E-05 | 3.00E-13 |
| CL-33820 | ≥9.8E+07 | 1.60E-05 | ≤1.6E-13 |
| CL-33855 | 2.00E+07 | ≤1.0E-06 | ≤5.0E-14 |

*Heterogeneous off-rate

Affinity matured humanized anti-PDGF-BB antibodies were characterized for PDGF-BB binding and potency. Human PDGF-BB binding affinity was determined by Biacore analysis (Example 1.1). Potency was evaluated in both cell-based and ELISA formats. The ability to block binding of hPDGF-BB to hPDGF-Rβ was tested in a competition ELISA format (Example 1.13) Inhibition of human and cynomolgus PDGF-BB-induced cell proliferation was assessed using NIH-3T3 cells (Examples 1.15 and 1.16). The data is summarized in Table 53 below.

TABLE 53

Summary of Characterization of Affinity Matured Humanized Anti-Human PDGF-BB Antibodies

| Affinity Matured Humanized IgG | PDGF-BB IC$_{50}$ Potency (nM) | | |
|---|---|---|---|
| | hPDGF-BB NIH-3T3 Proliferation | cynoPDGF-BB NIH-3T3 Proliferation | hPDGF-BB/ hPDGFR☐ Competition |
| CL-33578-Ig | 0.033 | 0.023 | 0.049 |
| CL-33587-Ig | 0.046 | 0.029 | <0.1 |
| CL-33675-Ig | 0.04 | 0.024 | 0.054 |
| CL-33682-Ig | 0.03 | 0.019 | 0.069 |
| CL-33683-Ig | 0.029 | 0.028 | 0.126 |
| CL-33699-Ig | 0.033 | 0.016 | 0.072 |
| CL-33706-Ig | 0.035 | 0.019 | 0.081 |
| CL-33731Ig | 0.036 | 0.023 | 0.068 |
| CL-33759-Ig | 0.293 | 0.18 | 1.267 |
| CL-33811-Ig | 0.032 | 0.012 | 0.1 |
| CL-33812-Ig | 0.033 | 0.028 | 0.043 |
| CL-33820-Ig | 0.017 | 0.013 | 0.066 |
| CL-33855-Ig | 0.037 | 0.019 | 0.162 |
| CL-33701-Ig | 0.056 | 0.012 | 0.059 |
| CL-33737-Ig | 0.03 | 0.024 | 0.092 |
| CL-33803-Ig | 0.024 | 0.018 | 0.044 |
| C-L33767-Ig | 0.09 | 0.042 | 0.114 |
| CL-33845-Ig | 0.171 | 0.073 | 0.409 |
| CL-33805-Ig | 0.039 | 0.018 | 0.063 |

Example 9: Methods of Selecting Preferred Humanized Antibodies as DVD-Ig Building Blocks

Example 9.1: A Technique for Assessing the Stability of Regions of the Parental Antibodies Intended for DVD-Ig Protein Incorporation The technique of differential scanning calorimetry (DSC) can be used to determine the thermal stabilities of the different domains of an antibody (e.g. CH2, CH3, CH1-CL, and VH-VL). The temperature of the highest peak in a DSC thermogram (plotted as heat capacity versus temperature) of an antibody has been shown to correspond to the midpoint of the unfolding transition or process of that antibody's VH-VL region due to increasing temperature. This may be interpreted as a measure of VH-VL thermal stability. VH-VL regions with high thermal stability in the antibody format will also likely have high thermal stability when incorporated into the DVD-Ig format as one of the binding domains. Therefore, antibodies can be screened to determine those with VH-VL regions of high thermal stability. Those regions can then be incorporated into the DVD-Ig format to increase the probability of generating a more stable DVD-Ig molecule.

Example 9.2: Determination of the Thermal Stability of the VH-VL Regions of Anti-VEGF mAbs and Anti-PDGF mAbs by Differential Scanning Calorimetry A total of 73 mAbs (45 anti-VEGF and 28 anti-PDGF) were selected and analyzed by DSC (Example 2.2) and the thermal stabilities of their VH-VL regions were quantitated by determining the temperature of the highest peak in the DSC thermograms as detailed in Example 9.1 (Table 54).

TABLE 54

Thermal Stability of Anti-VEGF and Anti-PDGF Antibodies

| Name | Target Antigen | Temperature of highest peak in DSC thermogram (° C.) |
|---|---|---|
| hBDB-4G8.1 | VEGF | 71.97 |
| hBDB-4G8.2 | VEGF | 69.13 |
| hBDB-4G8.3 | VEGF | 65.65 |
| hBDB-4G8.4 | VEGF | 75.27 |
| hBDB-4G8.5 | VEGF | 73.07 |
| hBDB-4G8.6 | VEGF | 68.68 |
| hBDB-4G8.7 | VEGF | 76.27 |
| hBDB-4G8.8 | VEGF | 73.16 |
| hBDB-4G8.9 | VEGF | 68.95 |
| hBDB-4G8.10 | VEGF | 73.44 |
| hBDB-4G8.11 | VEGF | 69.77 |
| hBDB-4G8.12 | VEGF | 67.48 |
| hBDB-4G8.13 | VEGF | 67.12 |
| hBDB-4G8.14 | VEGF | 63.4 |
| hBDB-4G8.15 | VEGF | 69.41 |
| h4G8.3 EI | VEGF | 68.31 |
| h4G8 CL-32416 | VEGF | 68.95 |
| h4G8 CL-34449 | VEGF | 72.7 |
| h4G8 CL-34455 | VEGF | 70.69 |
| h4G8 CL-34469 | VEGF | 70.23 |
| h4G8 CL-34475 | VEGF | 70.69 |
| h4G8 CL-34522 | VEGF | 67.49 |
| h4G8 CL-34540 | VEGF | 69.87 |
| h4G8 CL-34633 | VEGF | 69.22 |
| h4G8 CL-34538 | VEGF | 71.15 |
| h4G8 CL-34570 | VEGF | 66.84 |
| h4G8 CL-34565 | VEGF | 71.15 |
| hBEW-9A8.17 | VEGF | 64.56 |
| hBEW-9A8.21 | VEGF | 54.25 |
| hBEW-5C3.4 | VEGF | 66.94 |
| hBEW-9E10.1 | VEGF | 71.88 |
| hBEW-9E10.3 | VEGF | 71.24 |
| hBEW-9E10.4 | VEGF | 71.77 |
| hBEW-9E10.6 | VEGF | 71.24 |
| hBEW-9A8.20 | VEGF | 61.85 |
| hBEW-5C3.1 | VEGF | 63.15 |
| hBEW-5C3.5 | VEGF | 64.83 |
| hBEW-9E10.2 | VEGF | 71.37 |
| hBEW-9E10.5 | VEGF | 71.24 |
| hBEW-1B10.1 | VEGF | 87.95 |
| hBEW-1B10.2 | VEGF | 86.38 |
| hBEW-1E3.1 | VEGF | 62.74 |
| hBEW-1E3.2 | VEGF | 66.29 |
| hBEW-1E3.4 | VEGF | 66.11 |
| hBEW-1E3.5 | VEGF | 68.83 |
| hBDI-9E8.1 | PDGF | 77.6 |
| hBDI-9E8.2 | PDGF | 76.28 |
| hBDI-9E8.3 | PDGF | 87.4 |
| hBDI-9E8.4 | PDGF | 84.2 |
| hBDI-9E8.5 | PDGF | 77.69 |
| hBDI-9E8.6 | PDGF | 75.91 |
| hBDI-9E8.7 | PDGF | 87.4 |
| hBDI-9E8.8 | PDGF | 84.29 |
| hBDI-9E8.9 | PDGF | 82.09 |
| hBDI-9E8.10 | PDGF | 83.37 |
| hBDI-9E8.11 | PDGF | 80.9 |
| hBDI-9E8.12 | PDGF | 82.64 |
| hBDI-9E8.13 | PDGF | 85.39 |
| CL-33578-IgG | PDGF | 75.03 |
| CL-33587-IgG | PDGF | 76.37 |
| CL-33675-IgG | PDGF | 87.4 |
| CL-33682-IgG | PDGF | 78.52 |
| CL-33683-IgG | PDGF | 82.55 |
| CL-33701-IgG | PDGF | 73.62 |
| CL-33706-IgG | PDGF | 86.85 |
| CL-33731-IgG | PDGF | 77.33 |
| CL-33803-IgG | PDGF | 74.26 |
| CL-33805-IgG | PDGF | 80.35 |
| CL-33811-IgG | PDGF | 79.71 |
| CL-33812-IgG | PDGF | 78.15 |
| CL-33820-IgG | PDGF | 78.88 |
| CL-33855-IgG | PDGF | 82.18 |
| hBFU-3E2.1 | PDGF | 68.31 |

Example 10: Generation of Anti-VEGF-A/Anti-PDGF-BB DVD-Ig Molecules

The variable domain sequences from humanized anti-human VEGF-A and anti-human PDGF-BB mAbs were used to design the VH and VL domains of anti-human VEGF-A/anti-human PDGF-BB DVD-Ig molecules. In some cases, variable regions were synthesized using two-step PCR. Primers were designed with homologous flanking regions to the cloning vector and the linker region between each DVD variable pair. In some cases, variable regions were generated using gene synthesis. Bacterial transformations were performed to identify positive clones and constructs were harvested and purified for use in mammalian transfection using standard protocols known in the art.

The variable domains of the heavy and light chain were cloned in-frame into mutant human IgG1 (L234, 235A) heavy-chain or mutant human IgG1 (L234, 235A, H435A) heavy-chain, and kappa light-chain constant regions, respectively, into pHybE vectors to generate anti-human VEGF-A/anti-human PDGF-BB DVD-Ig molecules.

TABLE 55

Amino Acid Sequences of DVD-Ig Linkers

| Seq ID No | Name | Sequence |
|---|---|---|
| 3784 | HG-short | ASTKGP |
| 3785 | HG-long | ASTKGPSVFPLAP |
| 3786 | GS-H10 | GGGGSGGGGS |
| 3787 | LK-short | RTVAAP |
| 3788 | LK-long | RTVAAPSVFIFPP |
| 3789 | GS-L10 | RGGSGGGSG |
| 3790 | GS-L10(dR) | GGSGGGGSGG |
| 3791 | GS-L11 | RGGSGGGGSGG |
| 3792 | | AKTTPKLEEGEFSEAR |
| 3793 | | AKTTPKLEEGEFSEARV |
| 3794 | | AKTTPKLGG |
| 3795 | | SAKTTPKLGG |
| 3796 | | SAKTTP |
| 3797 | | RADAAP |
| 3798 | | RADAAPTVS |
| 3799 | | RADAAAAGGPGS |
| 3800 | | RADAAAA(G$_4$S)$_4$ |
| 3801 | | SAKTTPKLEEGEFSEARV |
| 3802 | | ADAAP |
| 3803 | | ADAAPTVSIFPP |
| 3804 | | TVAAP |
| 3805 | | TVAAPSVFIFPP |
| 3806 | | QPKAAP |
| 3807 | | QPKAAPSVTLFPP |
| 3808 | | AKTTPP |
| 3809 | | AKTTPPSVTPLAP |
| 3810 | | AKTTAP |
| 3811 | | AKTTAPSVYPLAP |
| 3812 | | ASTKGP |
| 3813 | | ASTKGPSVFPLAP |
| 3814 | | GGGGSGGGGSGGGGS |
| 3815 | | GENKVEYAPALMALS |
| 3816 | | GPAKELTPLKEAKVS |
| 3817 | | GHEAAAVMQVQYPAS |
| 3818 | | TVAAPSVFIFPPTVAAPSVFIFPP |
| 3819 | | ASTKGPSVFPLAPASTKGPSVFPLAP |
| 3820 | | GGGGSGGGGS |
| 3821 | | GGSGGGGSG G/S based sequences (e.g., G4S (SEQ ID NO: 3822) and G4S repeats ("G4S" disclosed as SEQ ID NO: 3822)) |

TABLE 56

Heavy (H) and Light Chain (L) Composition of Anti-VEGF-A/Anti-PDGF-BB DVD-Ig Molecules (first and second polypeptide chains are listed in alternating rows of the table)

| SEQ ID NO | Corporate ID | DVD-Ig Variable Domain Name | Outer Variable Domain Name | Linker | Inner Variable Domain Name | SEQ ID NO VD1-X1-VD2 Formula |
|---|---|---|---|---|---|---|
| | NA | AB014-GS-9E8.4[a] | AB014 VH | GS-H10 | hBDI-9E8.4 VH | |
| | | | AB014 VL | GS-L10 | hBDI-9E8.4 VL | |
| | NA | 9E8.4-GS-AB014[a] | hBDI-9E8.4 VH | GS-H10 | AB014 VH | |
| | | | hBDI-9E8.4 VL | GS-L10 | AB014 VL | |
| | NA | AB014-SS-9E8.4[a] | AB014 VH | HG-short | hBDI-9E8.4 VH | |
| | | | AB014 VL | LK-short | hBDI-9E8.4 VL | |
| | NA | 9E8.4-SS-AB014[a] | hBDI-9E8.4 VH | HG-short | AB014 VH | |
| | | | hBDI-9E8.4 VL | LK-short | AB014 VL | |

TABLE 56-continued

Heavy (H) and Light Chain (L) Composition of Anti-VEGF-A/Anti-PDGF-BB DVD-
Ig Molecules (first and second polypeptide chains are listed in alternating rows of the table)

| SEQ ID NO | Corporate ID | DVD-Ig Variable Domain Name | Outer Variable Domain Name | Linker | Inner Variable Domain Name | SEQ ID NO VD1-X1-VD2 Formula |
|---|---|---|---|---|---|---|
| NA | | AB014-SL-9E8.4[a] | AB014 VH | HG-short | hBDI-9E8.4 VH | |
| | | | AB014 VL | LK-long | hBDI-9E8.4 VL | |
| NA | | 9E8.4-SL-AB014[a] | hBDI-9E8.4 VH | HG-short | AB014 VH | |
| | | | hBDI-9E8.4 VL | LK-long | AB014 VL | |
| NA | | AB014-LS-9E8.4[a] | AB014 VH | HG-long | hBDI-9E8.4 VH | |
| | | | AB014 VL | LK-short | hBDI-9E8.4 VL | |
| NA | | 9E8.4-LS-AB014[a] | hBDI-9E8.4 VH | HG-long | AB014 VH | |
| | | | hBDI-9E8.4 VL | LK-short | AB014 VL | |
| | PR-1563988 | 9E8.4-GS-4G8.3[a] | hBDI-9E8.4 VH | GS-H10 | hBDB-4G8.3 VH | |
| | | | hBDI-9E8.4 VL | GS-L10 | hBDB-4G8.3 VL | |
| | PR-1563990 | 9E8.4-SS-4G8.3[a] | hBDI-9E8.4 VH | HG-short | hBDB-4G8.3 VH | |
| | | | hBDI-9E8.4 VL | LK-short | hBDB-4G8.3 VL | |
| | PR-1563998 | 9E8.4-SL-4G8.3[a] | hBDI-9E8.4 VH | HG-short | hBDB-4G8.3 VH | |
| | | | hBDI-9E8.4 VL | LK-long | hBDB-4G8.3 VL | |
| | PR-1564009 | 9E8.4-LS-4G8.3[a] | hBDI-9E8.4 VH | HG-long | hBDB-4G8.3 VH | |
| | | | hBDI-9E8.4 VL | LK-short | hBDB-4G8.3 VL | |
| | PR-1564010 | 4G8.3-GS-9E8.4[a] | hBDB-4G8.3 VH | GS-H10 | hBDI-9E8.4 VH | |
| | | | hBDB-4G8.3 VL | GS-H10 | hBDI-9E8.4 VL | |
| | PR-1564011 | 4G8.3-SS-9E8.4[a] | hBDB-4G8.3 VH | HG-short | hBDI-9E8.4 VH | |
| | | | hBDB-4G8.3 VL | LK-short | hBDI-9E8.4 VL | |
| | PR-1564012 | 4G8.3-SL-9E8.4[a] | hBDB-4G8.3 VH | HG-short | hBDI-9E8.4 VH | |
| | | | hBDB-4G8.3 VL | LK-long | hBDI-9E8.4 VL | |
| | PR-1564013 | 4G8.3-LS-9E8.4[a] | hBDB-4G8.3 VH | HG-long | hBDI-9E8.4 VH | |
| | | | hBDB-4G8.3 VL | LK-short | hBDI-9E8.4 VL | |
| | PR-1569574 | 9E8.4-GS-4G8.3 | hBDI-9E8.4 VH | GS-H10 | hBDB-4G8.3 VH | |
| | | | hBDI-9E8.4 VL | GS-L10 | hBDB-4G8.3 VL | |
| | PR-1569579 | 9E8.4-SL-4G8.3 | hBDI-9E8.4 VH | HG-short | hBDB-4G8.3 VH | |
| | | | hBDI-9E8.4 VL | LK-long | hBDB-4G8.3 VL | |
| | PR-1575573 | 9E8.4-LS-4G8.3 | hBDI-9E8.4 VH | HG-long | hBDB-4G8.3 VH | |
| | | | hBDI-9E8.4 VL | LK-short | hBDB-4G8.3 VL | |
| | PR-1572102 | 4G8.3-GS-9E8.4 (g) | hBDB-4G8.3 VH | GS-H10 | hBDI-9E8.4 VH | |
| | | | hBDB-4G8.3 VL | GS-L10 | hBDI-9E8.4 VL | |
| | PR-1572103 | 4G8.3-GS(11)-9E8.4 (g) | hBDB-4G8.3 VH | GS-H10 | hBDI-9E8.4 VH | |
| | | | hBDB-4G8.3 VL | GS-L11 | hBDI-9E8.4 VL | |
| | PR-1572104 | 4G8.3-GS(noR)-9E8.4 (g) | hBDB-4G8.3 VH | GS-H10 | hBDI-9E8.4 VH | |
| | | | hBDB-4G8.3 VL | GS-L10 (dR) | hBDI-9E8.4 VL | |
| | PR-1572105 | 4G8.3-SL-9E8.4 (g) | hBDB-4G8.3 VH | HG-short | hBDI-9E8.4 VH | |
| | | | hBDB-4G8.3 VL | LK-long | hBDI-9E8.4 VL | |
| | PR-1572106 | 4G8.3-LS-9E8.4 (g) | hBDB-4G8.3 VH | HG-long | hBDI-9E8.4 VH | |
| | | | hBDB-4G8.3 VL | LK-short | hBDI-9E8.4 VL | |
| | PR-1575832 | 4G8.3-GS-9E8.4E | hBDB-4G8.3 VH | GS-H10 | hBDI-9E8.4E VH | |
| | | | hBDB-4G8.3 VL | GS-L10 | hBDI-9E8.4E VL | |
| | PR-1575834 | 4G8.3-SL-9E8.4E | hBDB-4G8.3 VH | HG-short | hBDI-9E8.4E VH | |
| | | | hBDB-4G8.3 VL | LK-long | hBDI-9E8.4E VL | |
| | PR-1575835 | 4G8.3-LS-9E8.4E | hBDB-4G8.3 VH | HG-long | hBDI-9E8.4E VH | |
| | | | hBDB-4G8.3 VL | LK-short | hBDI-9E8.4E VL | |
| | PR-1577165 | 9A8.12-GS-9E8.4E | hBEW-9A8.12 VH | GS-H10 | hBDI-9E8.4E VH | |
| | | | hBEW-9A8.12 VL | GS-L10 | hBDI-9E8.4E VL | |
| | PR-1577166 | 9A8.12-SL-9E8.4E | hBEW-9A8.12 VH | HG-short | hBDI-9E8.4E VH | |
| | | | hBEW-9A8.12 VL | LK-long | hBDI-9E8.4E VL | |
| | PR-1577547 | 9A8.12-LS-9E8.4E | hBEW-9A8.12 VH | HG-long | hBDI-9E8.4E VH | |
| | | | hBEW-9A8.12 VL | LK-short | hBDI-9E8.4E VL | |
| | PR-1578137 | 9E8.4E-GS-9A8.12 | hBDI-9E8.4E VH | GS-H10 | hBEW-9A8.12 VH | |
| | | | hBDI-9E8.4E VL | GS-L10 | hBEW-9A8.12 VL | |
| | PR-1577548 | 9E8.4E-SL-9A8.12 | hBDI-9E8.4E VH | HG-short | hBEW-9A8.12 VH | |
| | | | hBDI-9E8.4E VL | LK-long | hBEW-9A8.12 VL | |
| | PR-1577550 | 9E8.4E-LS-9A8.12 | hBDI-9E8.4E VH | HG-long | hBEW-9A8.12 VH | |
| | | | hBDI-9E8.4E VL | LK-short | hBEW-9A8.12 VL | |
| | PR-1598261 | 4G8.2-GS-9E8.4 | hBDB-4G8.2 VH | GS-H10 | hBDI-9E8.4 VH | |
| | | | hBDB-4G8.2 VL | GS-L10 | hBDI-9E8.4 VL | |
| | PR-1598262 | 4G8.4-GS-9E8.4 | hBDB-4G8.4 VH | GS-H10 | hBDI-9E8.4 VH | |
| | | | hBDB-4G8.4 VL | GS-L10 | hBDI-9E8.4 VL | |
| | PR-1598263 | 4G8.5-GS-9E8.4 | hBDB-4G8.5 VH | GS-H10 | hBDI-9E8.4 VH | |
| | | | hBDB-4G8.5 VL | GS-L10 | hBDI-9E8.4 VL | |
| | PR-1598264 | 4G8.12-GS-9E8.4 | hBDB-4G8.12 VH | GS-H10 | hBDI-9E8.4 VH | |
| | | | hBDB-4G8.12 VL | GS-L10 | hBDI-9E8.4 VL | |
| | PR-1598265 | 4G8.13-GS-9E8.4 | hBDB-4G8.13 VH | GS-H10 | hBDI-9E8.4 VH | |
| | | | hBDB-4G8.13 VL | GS-L10 | hBDI-9E8.4 VL | |

TABLE 56-continued

Heavy (H) and Light Chain (L) Composition of Anti-VEGF-A/Anti-PDGF-BB DVD-
Ig Molecules (first and second polypeptide chains are listed in alternating rows of the table)

| SEQ ID NO | Corporate ID | DVD-Ig Variable Domain Name | Outer Variable Domain Name | Linker | Inner Variable Domain Name | SEQ ID NO VD1-X1-VD2 Formula |
|---|---|---|---|---|---|---|
| | PR-1598266 | 4G8.14-GS-9E8.4 | hBDB-4G8.14 VH<br>hBDB-4G8.14 VL | GS-H10<br>GS-L10 | hBDI-9E8.4 VH<br>hBDI-9E8.4 VL | |
| | PR-1613183 | CL-34565_GS_CL-33675 | CL-34565 VH<br>CL-34565 VL | GS-H10<br>GS-L10 (dR) | CL-33675 VH<br>CL-33675 VL | |
| | PR-1613184 | CL-34565_GS_9E8.4 | CL-34565 VH<br>CL-34565 VL | GS-H10<br>GS-L10 (dR) | hBDI-9E8.4 VH<br>hBDI-9E8.4 VL | |
| | PR-1613185 | CL-34565_GS_3E2.1 | CL-34565 VH<br>CL-34565 VL | GS-H10<br>GS-L10 (dR) | hBFU-3E2.1 VH<br>hBFU-3E2.1 VL | |
| | PR-1611291 | 4G8.5_GS_CL-33675 | hBDB-4G8.5 VH<br>hBDB-4G8.5 VL | GS-H10<br>GS-L10 (dR) | CL-33675 VH<br>CL-33675 VL | |
| | PR-1612489 | 4G8.5_GS_9E8.4 | hBDB-4G8.5 VH<br>hBDB-4G8.5 VL | GS-H10<br>GS-L10 (dR) | hBDI-9E8.4 VH<br>hBDI-9E8.4 VL | |
| | PR-1610560 | 4G8.5_GS_3E2.1 | hBDB-4G8.5 VH<br>hBDB-4G8.5 VL | GS-H10<br>GS-L10 (dR) | hBFU-3E2.1 VH<br>hBFU-3E2.1 VL | |
| | PR-1610561 | 9E10.1_GS_CL-33675 | hBEW-9E10.1 VH<br>hBEW-9E10.1 VL | GS-H10<br>GS-L10 (dR) | CL-33675 VH<br>CL-33675 VL | |
| | PR-1612491 | 9E10.1_GS_9E8.4 | hBEW-9E10.1 VH<br>hBEW-9E10.1 VL | GS-H10<br>GS-L10 (dR) | hBDI-9E8.4 VH<br>hBDI-9E8.4 VL | |
| | PR-1610562 | 9E10.1_GS_3E2.1 | hBEW-9E10.1 VH<br>hBEW-9E10.1 VL | GS-H10<br>GS-L10 (dR) | hBFU-3E2.1 VH<br>hBFU-3E2.1 VL | |
| | PR-1612492 | 9E10.6_GS_CL-33675 | hBEW-9E10.6 VH<br>hBEW-9E10.6 VL | GS-H10<br>GS-L10 (dR) | CL-33675 VH<br>CL-33675 VL | |
| | PR-1612493 | 9E10.6_GS_9E8.4 | hBEW-9E10.6 VH<br>hBEW-9E10.6 VL | GS-H10<br>GS-L10 (dR) | hBDI-9E8.4 VH<br>hBDI-9E8.4 VL | |
| | PR-1610563 | 9E10.6_GS_3E2.1 | hBEW-9E10.6 VH<br>hBEW-9E10.6 VL | GS-H10<br>GS-L10 (dR) | hBFU-3E2.1 VH<br>hBFU-3E2.1 VL | |
| | PR-1611292 | 1B10.1_GS_CL-33675 | hBEW-1B10.1 VH<br>hBEW-1B10.1 VL | GS-H10<br>GS-L10 (dR) | CL-33675 VH<br>CL-33675 VL | |
| | PR-1612494 | 1B10.1_GS_9E8.4 | hBEW-1B10.1 VH<br>hBEW-1B10.1 VL | GS-H10<br>GS-L10 (dR) | hBDI-9E8.4 VH<br>hBDI-9E8.4 VL | |
| | PR-1610564 | 1B10.1_GS_3E2.1 | hBEW-1B10.1 VH<br>hBEW-1B10.1 VL | GS-H10<br>GS-L10 (dR) | hBFU-3E2.1 VH<br>hBFU-3E2.1 VL | |
| | PR-1611293 | 1E3.4_GS_CL-33675 | hBEW-1E3.4 VH<br>hBEW-1E3.4 VL | GS-H10<br>GS-L10 (dR) | CL-33675 VH<br>CL-33675 VL | |
| | PR-1611294 | 1E3.4_GS_9E8.4 | hBEW-1E3.4 VH<br>hBEW-1E3.4 VL | GS-H10<br>GS-L10 (dR) | hBDI-9E8.4 VH<br>hBDI-9E8.4 VL | |
| | PR-1612495 | 1E3.4_GS_3E2.1 | hBEW-1E3.4 VH<br>hBEW-1E3.4 VL | GS-H10<br>GS-L10 (dR) | hBFU-3E2.1 VH<br>hBFU-3E2.1 VL | |
| | PR-1613186 | CL-33675_GS_CL-34565 | CL-33675 VH<br>CL-33675 VL | GS-H10<br>GS-L10 (dR) | CL-34565 VH<br>CL-34565 VL | |
| | PR-1612496 | CL-33675_GS_4G8.5 | CL-33675 VH<br>CL-33675 VL | GS-H10<br>GS-L10 (dR) | hBDB-4G8.5 VH<br>hBDB-4G8.5 VL | |
| | PR-1611295 | CL-33675_GS_9E10.1 | CL-33675 VH<br>CL-33675 VL | GS-H10<br>GS-L10 (dR) | hBEW-9E10.1 VH<br>hBEW-9E10.1 VL | |
| | PR-1611296 | CL-33675_GS_9E10.6 | CL-33675 VH<br>CL-33675 VL | GS-H10<br>GS-L10 (dR) | hBEW-9E10.6 VH<br>hBEW-9E10.6 VL | |
| | PR-1612498 | CL-33675_GS_1B10.1 | CL-33675 VH<br>CL-33675 VL | GS-H10<br>GS-L10 (dR) | hBEW-1B10.1 VH<br>hBEW-1B10.1 VL | |

TABLE 56-continued

Heavy (H) and Light Chain (L) Composition of Anti-VEGF-A/Anti-PDGF-BB DVD-
Ig Molecules (first and second polypeptide chains are listed in alternating rows of the table)

| SEQ ID NO | Corporate ID | DVD-Ig Variable Domain Name | Outer Variable Domain Name | Linker | Inner Variable Domain Name | SEQ ID NO VD1-X1-VD2 Formula |
|---|---|---|---|---|---|---|
| | PR-1611297 | CL-33675_GS_1E3.4 | CL-33675 VH | GS-H10 | hBEW-1E3.4 VH | |
| | | | CL-33675 VL | GS-L10 (dR) | hBEW-1E3.4 VL | |
| | PR-1613187 | 9E8.4_GS_CL-34565 | hBDI-9E8.4 VH | GS-H10 | CL-34565 VH | |
| | | | hBDI-9E8.4 VL | GS-L10 (dR) | CL-34565 VL | |
| | PR-1613188 | 9E8.4_GS_4G8.5 | hBDI-9E8.4 VH | GS-H10 | hBDB-4G8.5 VH | |
| | | | hBDI-9E8.4 VL | GS-L10 (dR) | hBDB-4G8.5 VL | |
| | PR-1611298 | 9E8.4_GS_9E10.1 | hBDI-9E8.4 VH | GS-H10 | hBEW-9E10.1 VH | |
| | | | | GS-L10 (dR) | hBEW-9E10.1H VL | |
| | PR-1611299 | 9E8.4_GS_9E10.6 | hBDI-9E8.4 VH | GS-H10 | hBEW-9E10.6 VH | |
| | | | hBDI-9E8.4 VL | GS-L10 (dR) | hBEW-9E10.6 VL | |
| | PR-1611300 | 9E8.4_GS_1B10.1 | hBDI-9E8.4 VH | GS-H10 | hBEW-1B10.1 VH | |
| | | | hBDI-9E8.4 VL | GS-L10 (dR) | hBEW-1B10.1 VL | |
| | PR-1611301 | 9E8.4_GS_1E3.4 | hBDI-9E8.4 VH | GS-H10 | hBEW-1E3.4 VH | |
| | | | hBDI-9E8.4 VL | GS-L10 (dR) | hBEW-1E3.4 VL | |
| | PR-1613189 | 3E2.1_GS_CL-34565 | hBFU-3E2.1 VH | GS-H10 | CL-34565 VH | |
| | | | hBFU-3E2.1 VL | GS-L10 (dR) | CL-34565 VL | |
| | PR-1612499 | 3E2.1_GS_4G8.5 | hBFU-3E2.1 VH | GS-H10 | hBDB-4G8.5 VH | |
| | | | hBFU-3E2.1 VL | GS-L10 (dR) | hBDB-4G8.5 VL | |
| | PR-1612500 | 3E2.1_GS_9E10.1 | hBFU-3E2.1 VH | GS-H10 | hBEW-9E10.1 VH | |
| | | | hBFU-3E2.1 VL | GS-L10 (dR) | hBEW-9E10.1 VL | |
| | PR-1612501 | 3E2.1_GS_9E10.6 | hBFU-3E2.1 VH | GS-H10 | hBEW-9E10.6 VH | |
| | | | hBFU-3E2.1 VL | GS-L10 (dR) | hBEW-9E10.6 VL | |
| | PR-1612502 | 3E2.1_GS_1B10.1 | hBFU-3E2.1 VH | GS-H10 | hBEW-1B10.1 VH | |
| | | | hBFU-3E2.1 VL | GS-L10 (dR) | hBEW-1B10.1 VL | |
| | PR-1613190 | 3E2.1_GS_1E3.4 | hBFU-3E2.1 VH | GS-H10 | hBEW-1E3.4 VH | |
| | | | hBFU-3E2.1 VL | GS-L10 (dR) | hBEW-1E3.4 VL | |
| | PR-1629646 | 9E10.1_SL_CL-33675 | hBEW-9E10.1 VH | HG-short | CL-33675 VH | |
| | | | hBEW-9E10.1 VL | LK-long | CL-33675 VL | |
| | PR-1629647 | 1B10.1_SL_CL-33675 | hBEW-1B10.1 VH | HG-short | CL-33675 VH | |
| | | | hBEW-1B10.1 VL | LK-long | CL-33675 VL | |
| | PR-1629648 | 9E10.1_LS_CL-33675 | hBEW-9E10.1 VH | HG-long | CL-33675 VH | |
| | | | hBEW-9E10.1 VL | LK-short | CL-33675 VL | |
| | PR-1629649 | 1B10.1_LS_CL-33675 | hBEW-1B10.1 VH | HG-long | CL-33675 VH | |
| | | | hBEW-1B10.1 VL | LK-short | CL-33675 VL | |
| | PR-1564883 | DVD3896[a] | hBDI-5H1.9 VH | HG-short | hBDB-4G8.13 VH | |
| | | | hBDI-5H1.9 VL | LK-long | hBDB-4G8.13 VL | |
| | PR-1564893 | DVD3897[a] | hBDI-5H1.9 VH | HG-short | hBDB-4G8.14 VH | |
| | | | hBDI-5H1.9 VL | LK-long | hBDB-4G8.14 VL | |
| | PR-1564896 | DVD3898[a] | hBDI-5H1.9 VH | HG-short | hBDB-4G8.15 VH | |
| | | | hBDI-5H1.9 VL | LK-long | hBDB-4G8.15 VL | |
| | PR-1564898 | DVD3899[a] | hBDI-9E8.12 VH | HG-short | hBDB-4G8.14 VH | |
| | | | hBDI-9E8.12 VL | LK-long | hBDB-4G8.14 VL | |

TABLE 56-continued

Heavy (H) and Light Chain (L) Composition of Anti-VEGF-A/Anti-PDGF-BB DVD-Ig Molecules (first and second polypeptide chains are listed in alternating rows of the table)

| SEQ ID NO | Corporate ID | DVD-Ig Variable Domain Name | Outer Variable Domain Name | Linker | Inner Variable Domain Name | SEQ ID NO VD1-X1-VD2 Formula |
|---|---|---|---|---|---|---|
| | PR-1564899 | DVD3900<sup>a</sup> | hBDI-9E8.12 VH | HG-short | hBDB-4G8.15 VH | |
| | | | hBDI-9E8.12 VL | LK-long | hBDB-4G8.15 VL | |
| | PR-1565023 | DVD3901<sup>a</sup> | hBDI-9E8.9 VH | HG-short | hBDB-4G8.13 VH | |
| | | | hBDI-9E8.9 VL | LK-long | hBDB-4G8.13 VL | |
| | PR-1565029 | DVD3902<sup>a</sup> | hBDI-9E8.9 VH | HG-short | hBDB-4G8.14 VH | |
| | | | hBDI-9E8.9 VL | LK-long | hBDB-4G8.14 VL | |
| | PR-1565030 | DVD3903<sup>a</sup> | hBDI-9E8.9 VH | HG-short | hBDB-4G8.15 VH | |
| | | | hBDI-9E8.9 VL | LK-long | hBDB-4G8.15 VL | |
| | PR-1565031 | DVD3904<sup>a</sup> | hBDI-5H1.13 VH | HG-short | hBDB-4G8.14 VH | |
| | | | hBDI-5H1.13 VL | LK-long | hBDB-4G8.14 VL | |
| | PR-1565032 | DVD3905<sup>a</sup> | hBDI-9E8.12 VH | HG-short | hBDB-4G8.15 VH | |
| | | | hBDI-9E8.12 VL | LK-long | hBDB-4G8.15 VL | |
| | PR-1565035 | DVD3906<sup>a</sup> | hBDI-5H1.13 VH | HG-short | hBDB-4G8.15 VH | |
| | | | hBDI-5H1.13 VL | LK-long | hBDB-4G8.15 VL | |
| | PR-1565033 | DVD3907<sup>a</sup> | hBDI-9E8.13 VH | HG-short | hBDB-4G8.15 VH | |
| | | | hBDI-9E8.13 VL | LK-long | hBDB-4G8.15 VL | |

<sup>a</sup>These DVDs were made with Ig gamma-1 constant region L234A, L235A, all other DVDs made with Ig gamma-1 constant region L234A, L235A, and H435A.

TABLE 57

Heavy (H) and Light Chain (L) Amino Acid Composition of Some Anti-VEGF-A/Anti-PDGF-BB DVD-Ig Molecules (Linker sequence in italics; CDR sequences in bold; HC = heavy chain and LC = light chain)

| Sequence Identifier | DVD-Ig Variable Domain (Corporate ID) | Sequence 123456789012345678901234567890012 |
|---|---|---|
| SEQ ID NO: 3823 | 4G8.3-GS-9E8.4 HC (PR-1569574) | EVQLVQSGSELKKPGASVKVSCKASGYTFTNY GMYWVRQAPGQGLEWMGWINTETGKPTYADDF KGRFVFSLDTSVSTAYLQISSLKAEDTAVYYC ARTNYYYRSYIFYFDYWGQGTMVTSS*GGGGS GGGGS*EVTLRESGPALVKPTQTLTLTCTFSGF SLSTYGMGVGWIRQPPGKALEWLANIWWDDDK YYNPSLKNRLTISKDTSKNQVVLTMTNMDPVD TATYYCARIESIGTTYSFDYWGQGTMVTVSSA STKGPSVFPLAPSSKSTSGGTAALGCLVKDYF PEPVTVSWNSGALTSGVHTFPAVLQSSGLYSL SSVVTVPSSSLGTQTYICNVNHKPSNTKVDKK VEPKSCDKTHTCPPCPAPEAAGGPSVFLFPPK PKDTLMISRTPEVTCVVVDVSHEDPEVKFNWY VDGVEVHNAKTKPREEQYNSTYRVVSVLTVLH QDWLNGKEYKCKVSNKALPAPIEKTISKAKGQ PREPQVYTLPPSREEMTKNQVSLTCLVKGFYP SDIAVEWESNGQPENNYKTTPPVLDSDGSFFL YSKLTVDKSRWQQGNVFSCSVMHEALHNAYTQ KSLSLSPGK |
| SEQ ID NO: 3824 | 4G8.3-GS-9E8.4 LC (PR-1569574) | DTVLTQSPATLSLSPGERATLSCRASESVSTH MHWYQQKPGQAPRLLIYGASNLESGVPARFSG SGSGTDFTLTISSLEPEDFAVYFCQQSWNDPF TFGQGTKLEIKR*GGSGGGGS*EFVLTQSPGTL SLSPGERATLSCERSSGDIGDSYVSWYQQKPG |

TABLE 57-continued

Heavy (H) and Light Chain (L) Amino Acid Composition of
Some Anti-VEGF-A/Anti-PDGF-BB DVD-Ig Molecules
(Linker sequence in italics; CDR sequences in bold;
HC = heavy chain and LC = light chain)

| Sequence Identifier | DVD-Ig Variable Domain (Corporate ID) | Sequence 123456789012345678901234567890 |
|---|---|---|
| | | QAPRLVIYADDQRPSGIPDRFSGSGSGTDFTL TISRLEPEDFAVYYCQSYDINIDIVFGGGTKV EIKGTVAAPSVFIFPPSDEQLKSGTASVVCLL NNFYPREAKVQWKVDNALQSGNSQESVTEQDS KDSTYSLSSTLTLSKADYEKHKVYACEVTHQG LSSPVTKSFNRGEC |
| SEQ ID NO: 3825 | 4G8.3-SL-9E8.4 HC (PR-1569579) | EVQLVQSGSELKKPGASVKVSCKASGYTFTNY GMYWVRQAPGQGLEWMGWINTETGKPTYADDF KGRFVFSLDTSVSTAYLQISSLKAEDTAVYYC ARTNYYYRSYIFYFDYWGQGTMVTVSS*ASTKG PE*VTLRESGPALVKPTQTLTLTCTFSGFSLST YGMGVGWIRQPPGKALEWLANIWWDDDKYYNP SLKNRLTISKDTSKNQVVLTMTNMDPVDTATY YCARIESIGTTYSFDYWGQGTMVTVSSASTKG PSVFPLAPSSKSTSGGTAALGCLVKDYFPEPV TVSWNSGALTSGVHTFPAVLQSSGLYSLSSVV TVPSSSLGTQTYICNVNHKPSNTKVDKKVEPK SCDKTHTCPPCPAPEAAGGPSVFLFPPKPKDT LMISRTPEVTCVVVDVSHEDPEVKFNWYVDGV EVHNAKTKPREEQYNSTYRVVSVLTVLHQDWL NGKEYKCKVSNKALPAPIEKTISKAKGQPREP QVYTLPPSREEMTKNQVSLTCLVKGFYPSDIA VEWESNGQPENNYKTTPPVLDSDGSFFLYSKL TVDKSRWQQGNVFSCSVMHEALHNAYTQKSLS LSPGK |
| SEQ ID NO: 3826 | 4G8.3-SL-9E8.4 LC (PR-1569579) | DTVLTQSPATLSLSPGERATLSCRASESVSTH MHWYQQKPGQAPRLLIYGASNLESGVPARFSG SGSGTDFTLTISSLEPEDFAVYFCQQSWNDPF TFGQGTKLEIKR*TVAAPSVFIFPP*EFVLTQSP GTLSLSPGERATLSCERSSGDIGDSYVSWYQQ KPGQAPRLVIYADDQRPSGIPDRFSGSGSGTD FTLTISRLEPEDFAVYYCQSYDINIDIVFGGG TKVEIKGTVAAPSVFIFPPSDEQLKSGTASVV CLLNNFYPREAKVQWKVDNALQSGNSQESVTE QDSKDSTYSLSSTLTLSKADYEKHKVYACEVT HQGLSSPVTKSFNRGEC |
| SEQ ID NO: 3827 | 4G8.3-LS-9E8.4 HC (PR-1575573) | EVQLVQSGSELKKPGASVKVSCKASGYTFTNY GMYWVRQAPGQGLEWMGWINTETGKPTYADDF KGRFVFSLDTSVSTAYLQISSLKAEDTAVYYC ARTNYYYRSYIFYFDYWGQGTMVTVSS*ASTKG PSVFPLAP*EVTLRESGPALVKPTQTLTLTCTF SGFSLSTYGMGVGWIRQPPGKALEWLANIWWD DDKYYNPSLKNRLTISKDTSKNQVVLTMTNMD PVDTATYYCARIESIGTTYSFDYWGQGTMVTV SSASTKGPSVFPLAPSSKSTSGGTAALGCLVK DYFPEPVTVSWNSGALTSGVHTFPAVLQSSGL YSLSSVVTVPSSSLGTQTYICNVNHKPSNTKV DKKVEPKSCDKTHTCPPCPAPEAAGGPSVFLF PPKPKDTLMISRTPEVTCVVVDVSHEDPEVKF NWYVDGVEVHNAKTKPREEQYNSTYRVVSVLT VLHQDWLNGKEYKCKVSNKALPAPIEKTISKA KGQPREPQVYTLPPSREEMTKNQVSLTCLVKG FYPSDIAVEWESNGQPENNYKTTPPVLDSDGS FFLYSKLTVDKSRWQQGNVFSCSVMHEALHNA YTQKSLSLSPGK |
| SEQ ID NO: 3828 | 4G8.3-LS-9E8.4 LC (PR-1575573) | DTVLTQSPATLSLSPGERATLSCRASESVSTH MHWYQQKPGQAPRLLIYGASNLESGVPARFSG SGSGTDFTLTISSLEPEDFAVYFCQQSWNDPF TFGQGTKLEIKR*TVAAP*EFVLTQSPGTLSLSP GERATLSCERSSGDIGDSYVSWYQQKPGQAPR LVIYADDQRPSGIPDRFSGSGSGTDFTLTISR LEPEDFAVYYCQSYDINIDIVFGGGTKVEIKG TVAAPSVFIFPPSDEQLKSGTASVVCLLNNFY PREAKVQWKVDNALQSGNSQESVTEQDSKDST YSLSSTLTLSKADYEKHKVYACEVTHQGLSSP VTKSFNRGEC |

TABLE 57-continued

Heavy (H) and Light Chain (L) Amino Acid Composition of
Some Anti-VEGF-A/Anti-PDGF-BB DVD-Ig Molecules
(Linker sequence in italics; CDR sequences in bold;
HC = heavy chain and LC = light chain)

| Sequence Identifier | DVD-Ig Variable Domain (Corporate ID) | Sequence 123456789012345678901234567890123456789012 |
|---|---|---|
| SEQ ID NO: 3829 | 4G8.3-GS-9E8.4 (g) HC (PR-1572102) | EVQLVQSGSELKKPGASVKVSCKASGYTFTNY GMYWVRQAPGQGLEWMGWINTETGKPTYADDF KGRFVFSLDTSVSTAYLQISSLKAEDTAVYYC ARTNYYYRSYIFYFDYWGQGTMVTVSS*GGGGS GGGGS*EVTLRESGPALVKPTQTLTLTCTFSGF SLSTYGMGVGWIRQPPGKALEWLANIWWDDDK YYNPSLKNRLTISKDTSKNQVVLTMTNMDPVD TATYYCARIESIGTTYSFDYWGQGTMVTVSSA STKGPSVFPLAPSSKSTSGGTAALGCLVKDYF PEPVTVSWNSGALTSGVHTFPAVLQSSGLYSL SSVVTVPSSSLGTQTYICNVNHKPSNTKVDKK VEPKSCDKTHTCPPCPAPEAAGGPSVFLFPPK PKDTLMISRTPEVTCVVVDVSHEDPEVKFNWY VDGVEVHNAKTKPREEQYNSTYRVVSVLTVLH QDWLNGKEYKCKVSNKALPAPIEKTISKAKGQ PREPQVYTLPPSREEMTKNQVSLTCLVKGFYP SDIAVEWESNGQPENNYKTTPPVLDSDGSFFL YSKLTVDKSRWQQGNVFSCSVMHEALHNAYTQ KSLSLSPGK |
| SEQ ID NO: 3830 | 4G8.3-GS-9E8.4 (g) LC (PR-1572102) | DTVLTQSPATLSLSPGERATLSCRASESVSTH MHWYQQKPGQAPRLLIYGASNLESGVPARFSG SGSGTDFTLTISSLEPEDFAVYFCQQSWNDPF TFGQGTKLEIK*RGGSGGGGS*GEFVLTQSPGTL SLSPGERATLSCERSSGDIGDSYVSWYQQKPG QAPRLVIYADDQRPSGIPDRFSGSGSGTDFTL TISRLEPEDFAVYYCQSYDINIDIVFGGGTKV EIKRTVAAPSVFIFPPSDEQLKSGTASVVCLL NNFYPREAKVQWKVDNALQSGNSQESVTEQDS KDSTYSLSSTLTLSKADYEKHKVYACEVTHQG LSSPVTKSFNRGEC |
| SEQ ID NO: 3831 | 4G8.3-SL-9E8.4 (g) HC (PR-1572105) | EVQLVQSGSELKKPGASVKVSCKASGYTFTNY GMYWVRQAPGQGLEWMGWINTETGKPTYADDF KGRFVFSLDTSVSTAYLQISSLKAEDTAVYYC ARTNYYYRSYIFYFDYWGQGTMVTVSS*ASTKG PEVTLRESGPALVKPTQTLTLTCTFSGFSLST YGMGVGWIRQPPGKALEWLANIWWDDDKYYNP SLKNRLTISKDTSKNQVVLTMTNMDPVDTATY YCARIESIGTTYSFDYWGQGTMVTVSSASTKG PSVFPLAPSSKSTSGGTAALGCLVKDYFPEPV TVSWNSGALTSGVHTFPAVLQSSGLYSLSSVV TVPSSSLGTQTYICNVNHKPSNTKVDKKVEPK SCDKTHTCPPCPAPEAAGGPSVFLFPPKPKDT LMISRTPEVTCVVVDVSHEDPEVKFNWYVDGV EVHNAKTKPREEQYNSTYRVVSVLTVLHQDWL NGKEYKCKVSNKALPAPIEKTISKAKGQPREP QVYTLPPSREEMTKNQVSLTCLVKGFYPSDIA VEWESNGQPENNYKTTPPVLDSDGSFFLYSKL TVDKSRWQQGNVFSCSVMHEALHNAYTQKSLS LSPGK |
| SEQ ID NO: 3832 | 4G8.3-SL-9E8.4 (g) LC (PR-1572105) | DTVLTQSPATLSLSPGERATLSCRASESVSTH MHWYQQKPGQAPRLLIYGASNLESGVPARFSG SGSGTDFTLTISSLEPEDFAVYFCQQSWNDPF TFGQGTKLEIK*RTVAAPSVFIFPP*EFVLTQSP GTLSLSPGERATLSCERSSGDIGDSYVSWYQQ KPGQAPRLVIYADDQRPSGIPDRFSGSGSGTD FTLTISRLEPEDFAVYYCQSYDINIDIVFGGG TKVEIKrTVAAPSVFIFPPSDEQLKSGTASVV CLLNNFYPREAKVQWKVDNALQSGNSQESVTE QDSKDSTYSLSSTLTLSKADYEKHKVYACEVT HQGLSSPVTKSFNRGEC |
| SEQ ID NO: 3833 | 9E10.1_GS_CL-33675 HC (PR-1610561) | EIQLVQSGSELKKPGASVKVSCKASGYTFTNY GMYWVKQAPGQGLEYMGWIDTETGRPTYADDF KGRFVFSLDTSVSTAYLQISSLKAEDTAVYFC ARWSGDTTGIRGPWFAYWGQGTLVTVSS*GGGG |

TABLE 57-continued

Heavy (H) and Light Chain (L) Amino Acid Composition of
Some Anti-VEGF-A/Anti-PDGF-BB DVD-Ig Molecules
(Linker sequence in italics; CDR sequences in bold;
HC = heavy chain and LC = light chain)

| Sequence Identifier | DVD-Ig Variable Domain (Corporate ID) | Sequence 123456789012345678901234567890123456789012 |
|---|---|---|
| | | *SGGGGS*EVTLRESGPALVKPTQTLTLTCTFSG FSLSTYGMGVGWIRQPPGKALEWLANIWWDDD KYYNPSLKNRLTISKDTSKNQVVLTMTNMDPV DTATYYCARIESSGPKYSFDYWGQGTMVTVSS ASTKGPSVFPLAPSSKSTSGGTAALGCLVKDY FPEPVTVSWNSGALTSGVHTFPAVLQSSGLYS LSSVVTVPSSSLGTQTYICNVNHKPSNTKVDK KVEPKSCDKTHTCPPCPAPEAAGGPSVFLFPP KPKDTLMISRTPEVTCVVVDVSHEDPEVKFNW YVDGVEVHNAKTKPREEQYNSTYRVVSVLTVL HQDWLNGKEYKCKVSNKALPAPIEKTISKAKG QPREPQVYTLPPSREEMTKNQVSLTCLVKGFY PSDIAVEWESNGQPENNYKTTPPVLDSDGSFF LYSKLTVDKSRWQQGNVFSCSVMHEALHNAYT QKSLSLSPGK |
| SEQ ID NO: 3834 | 9E10.1_GS_CL-33675 LC (PR-1610561) | DIRMTQSPSSLSASVGDRVTIECLASEDIYSD LAWYQQKPGKSPKLLIYNANGLQNGVPSRFSG SGSGTDYSLTISSLQPEDVATYFCQQYNYFPG TFGQGTKLEIK*GGSGGGGSGG*EIVLTQSPGTL SLSPGERATLSCRASSGSIWYSFVSWYQQKPG QAPRLLIYADDQRASGIPDRFSGSGSGTDFTL TISRLEPEDFAVYYCQSYGINIDVVFGGGTKV EIKRTVAAPSVFIFPPSDEQLKSGTASVVCLL NNFYPREAKVQWKVDNALQSGNSQESVTEQDS KDSTYSLSSTLTLSKADYEKHKVYACEVTHQG LSSPVTKSFNRGEC |
| SEQ ID NO: 3835 | 1B10.1_GS_CL-33675 HC (PR-1611292) | EVQLVESGGGLVQPGGSLRLSCAASGFSFSKY DMAWFRQAPGKGLEWVASITTSGVGTYYRDSV KGRFTVSRDNAKSTLYLQMNSLRAEDTAVYYC ARGYGAMDAWGQGTTVTVSS*GGGGSGGGGSEV TLRESGPALVKPTQTLTLTCTFS*GFSLSTYGM GVGWIRQPPGKALEWLANIWWDDDKYYNPSLK NRLTISKDTSKNQVVLTMTNMDPVDTATYYCA RIESSGPKYSFDYWGQ GTMVTVSSASTKGPSVFPLAPSSKSTSGGTAA LGCLVKDYFPEPVTVSWNSGALTSGVHTFPAV LQSSGLYSLSSVVTVPSSSLGTQTYICNVNHK PSNTKVDKKVEPKSCDKTHTCPPCPAPEAAGG PSVFLFPPKPKDTLMISRTPEVTCVVVDVSHE DPEVKFNWYVDGVEVHNAKTKPREEQYNSTYR VVSVLTVLHQDWLNGKEYKCKVSNKALPAPIE KTISKAKGQPREPQVY TLPPSREEMTKNQVSLTCLVKGFYPSDIAVEW ESNGQPENNYKTTPPVLDSDGSFFLYSKLTVD KSRWQQGNVFSCSVMHEALHNAYTQKSLSLSP GK |
| SEQ ID NO: 3836 | 1B10.1_GS_CL-33675 LC (PR-1611292) | DIQMTQSPSSLSASVGDRVTITCKASQDIDDY LSWYQQKPGKSPKLVIYAATRLADGVPSRFSG SGSGTDYTLTISSLQPEDFATYYCLQSSSTPW TFGGGTKVEIK*GGSGGGGSGG*EIVLTQSPGTL SLSPGERATLSCRASSGSIWYSFVSWYQQKPG QAPRLLIYADDQRASGIPDRFSGSGSGTDFTL TISRLEPEDFAVYYCQSYGINIDVVFGGGTKV EIKRTVAAPSVFIFPP SDEQLKSGTASVVCLLNNFYPREAKVQWKVDN ALQSGNSQESVTEQDSKDSTYSLSSTLTLSKA DYEKHKVYACEVTHQGLSSPVTKSFNRGEC |

Example 11: Generation of CO-DVD-Ig Molecules

Cross-over DVD-Ig binding proteins are constructed as shown below. Each of VD1, VD2, VD3 and VD4 could be the VH or VL from a mAb. In cross-over DVD-Ig, VD1 and VD4 form one antigen binding domain. VD2 and VD3 form another binding domain.

TABLE 58

Heavy Chain and Light Chain Amino Acid Sequences of Anti-Human VEGF-A/Anti-Human PDGF-BB Cross-over DVD-Ig Molecules
(Linker sequence in italics; CDR sequences in bold)

| Seq ID No | Name (Corporate ID) | Sequence 12345678901234567890123456789012345678 90 |
|---|---|---|
| 3844 | CODV001 HC (PR-1565040) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSS*GEVTLKESGPALVKPTQTLTLTCTFS*GFSLSTFGMGV GWIRQPPGKALEWLANIWWDDDKYYNPSLKNRLTISKDTS KNQAVLTITNMDPVDTATYYCARISTGISSYYVMDAWGQG TTVTVSS*GGASTKGPSVFPLAPSSKSTSGGTAALGCLVKD YFPEPVTVSWNSGALTSGVHTFPAVLQSSGLYSLSSVVTV PSSSLGTQTYICNVNHKPSNTKVDKKVEPKSCDKTHTCPP CPAPEAAGGPSVFLFPPKPKDTLMISRTPEVTCVVVDVSH EDPEVKFNWYVDGVEVHNAKTKPREEQYNSTYRVVSVLTV LHQDWLNGKEYKCKVSNKALPAPIEKTISKAKGQPREPQV YTLPPSREEMTKNQVSLTCLVKGFYPSDIAVEWESNGQPE NNYKTTPPVLDSDGSFFLYSKLTVDKSRWQQGNVFSCSVM HEALHNHYTQKSLSLSPGK |
| 3845 | CODV001 LC (PR-1565040) | DFQLTQSPSSLSASVGDRVTITCERSSGDIGDTYVSWYQQ KPGKAPKNVIYGNDQRPSGVPSRFSGSGSGNSATLTISSL QPEDFATYFCQSYDSDIDIVFGQGTKVEIK*GGGSGGG*DIQ MTQSPSSLSASVGDRVTITCSASQDISNYLNWYQQKPGKA PKVLIYFTSSLHSGVPSRFSGSGSGTDFTLTISSLQPEDF ATYYCQQYSTVPWTFGQGTKVEIK*GGGS*GRTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 3837 | CODV002 HC (PR-1565042) | EVTLKESGPALVKPTQTLTLTCTFSGFSLSTFGMGVGWIR QPPGKALEWLANIWWDDDKYYNPSLKNRLTISKDTSKNQA VLTITNMDPVDTATYYCARISTGISSYYVMDAWGQGTTVT VSS*GEVQLVESGGGLVQPGGSLRLSCAAS*GYTFTNYGMNW VRQAPGKGLEWVGWINTYTGEPTYAADFKRRFTFSLDTSK STAYLQMNSLRAEDTAVYYCAKYPHYYGSSHWYFDVWGQG TLVTVSS*GGASTKGPSVFPLAPSSKSTSGGTAALGCLVKD YFPEPVTVSWNSGALTSGVHTFPAVLQSSGLYSLSSVVTV PSSSLGTQTYICNVNHKPSNTKVDKKVEPKSCDKTHTCPP CPAPEAAGGPSVFLFPPKPKDTLMISRTPEVTCVVVDVSH EDPEVKFNWYVDGVEVHNAKTKPREEQYNSTYRVVSVLTV LHQDWLNGKEYKCKVSNKALPAPIEKTISKAKGQPREPQV YTLPPSREEMTKNQVSLTCLVKGFYPSDIAVEWESNGQPE NNYKTTPPVLDSDGSFFLYSKLTVDKSRWQQGNVFSCSVM HEALHNHYTQKSLSLSPGK |
| 3838 | CODV002 LC (PR-1565042) | DIQMTQSPSSLSASVGDRVTITCSASQDISNYLNWYQQKP GKAPKVLIYFTSSLHSGVPSRFSGSGSGTDFTLTISSLQP EDFATYYCQQYSTVPWTFGQGTKVEIK*GGGSGGG*DFQLTQ SPSSLSASVGDRVTITCERSSGDIGDTYVSWYQQKPGKAP KNVIYGNDQRPSGVPSRFSGSGSGNSATLTISSLQPEDFA TYFCQSYDSDIDIVFGQGTKVEIK*GGGS*GRTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 213 | CODV003 HC (PR-1565044) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSS*GEVTLRESGPALVKPTQTLTLTCTFS*GFSLSTYGMGV GWIRQPPGKGLEWLANIWWDDDKYYNPSLKNRLTISKDTS KNQAVLTITNMDPVDTATYYCARESIGTTYSFDYWGQGT MVTVSS*GGASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNHYTQKSLSLSPGK |
| 214 | CODV003 LC (PR-1565044) | DFQLTQSPSSLSASVGDRVTITCERSSGDIGDSYVSWYQQ KPGKAPKNVIYADDQRPSGVPSRFSGSGSGNSASLTISSL QPEDFATYFCQSYDINIDIVFGQGTKVEIK*GGGSGGG*DIQ MTQSPSSLSASVGDRVTITCSASQDISNYLNWYQQKPGKA PKVLIYFTSSLHSGVPSRFSGSGSGTDFTLTISSLQPEDF |

TABLE 58-continued

Heavy Chain and Light Chain Amino Acid Sequences of Anti-Human
VEGF-A/Anti-Human PDGF-BB Cross-over DVD-Ig Molecules
(Linker sequence in italics; CDR sequences in bold)

| Seq ID No | Name (Corporate ID) | Sequence 12345678901234567890123456789012345678 90 |
|---|---|---|
| | | ATYYCQQYSTVPWTFGQGTKVEIK*GGGS*GRTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 215 | CODV004 HC (PR-1565051) | EVTLRESGPALVKPTQTLTLTCTFSGFSLSTYGMGVGWIR QPPGKGLEWLANIWWDDDKYYNPSLKNRLTISKDTSKNQA VLTITNMDPVDTATYYCARIESIGTTYSFDYWGQGTMVTV SS*GEVQLVESGGGLVQPGGSLRLSCAAS*GYTFTNYGMNWV RQAPGKGLEWVGWINTYTGEPTYAADFKRRFTFSLDTSKS TAYLQMNSLRAEDTAVYYCAKYPHYYGSSHWYFDVWGQGT LVTVSS*GGASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNHYTQKSLSLSPGK |
| 216 | CODV004 LC (PR-1565051) | DIQMTQSPSSLSASVGDRVTITCSASQDISNYLNWYQQKP GKAPKVLIYFTSSLHSGVPSRFSGSGSGTDFTLTISSLQP EDFATYYCQQYSTVPWTFGQGTKVEIK*GGGSGGGG*DFQLTQ SPSSLSASVGDRVTITCERSSGDIGDSYVSWYQQKPGKAP KNVIYADDQRPSGVPSRFSGSGSGNSASLTISSLQPEDFA TYFCQSYDINIDIVFGQGTKVEIK*GGGS*GRTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 217 | CODV005 HC (PR-1565083) | EVQLVESGGGLVQPGGSLRLSCAASGYTFTNYGMYWVKQA PGKGLEYMGWINTETGKPTYADDFKGRFTFSLDTSKSTAY LQMNSLRAEDTAVYFCARTNYYYRSYIFYFDYWGQGTLVT VSS*GEVTLKESGPALVKPTQTLTLTCTFS*GFSLSTFGMGV GWIRQPPGKALEWLANIWWDDDKYYNPSLKNRLTISKDTS KNQAVLTITNMDPVDTATYYCARISTGISSYYVMDAWGQG TTVTVSS*GGASTKGPSVFPLAPSSKSTSGGTAALGCLVKD YFPEPVTVSWNSGALTSGVHTFPAVLQSSGLYSLSSVVTV PSSSLGTQTYICNVNHKPSNTKVDKKVEPKSCDKTHTCPP CPAPEAAGGPSVFLFPPKPKDTLMISRTPEVTCVVVDVSH EDPEVKFNWYVDGVEVHNAKTKPREEQYNSTYRVVSVLTV LHQDWLNGKEYKCKVSNKALPAPIEKTISKAKGQPREPQV YTLPPSREEMTKNQVSLTCLVKGFYPSDIAVEWESNGQPE NNYKTTPPVLDSDGSFFLYSKLTVDKSRWQQGNVFSCSVM HEALHNHYTQKSLSLSPGK |
| 218 | CODV005 LC (PR-1565083) | DFQLTQSPSSLSASVGDRVTITCERSSGDIGDTYVSWYQQ KPGKAPKNVIYGNDQRPSGVPSRFSGSGSGNSATLTISSL QPEDFATYFCQSYDSDIDIVFGQGTKVEIK*GGGSGGGG*DTQ LTQSPSSLSASVGDRVTISCRASESVSTHMHWYQQKPGKA PKLLIYGASNLESGVPSRFSGSGSGTDFTLTISSLQPEDF ATYFCQQSWNDPFTFGQGTKVEIK*GGGS*GRTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 219 | CODV006 HC (PR-1565084) | EVTLKESGPALVKPTQTLTLTCTFSGFSLSTFGMGVGWIR QPPGKALEWLANIWWDDDKYYNPSLKNRLTISKDTSKNQA VLTITNMDPVDTATYYCARISTGISSYYVMDAWGQGTTVT VSS*GEVQLVESGGGLVQPGGSLRLSCAAS*GYTFTNYGMYW VKQAPGKGLEYMGWINTETGKPTYADDFKGRFTFSLDTSK STAYLQMNSLRAEDTAVYFCARTNYYYRSYIFYFDYWGQG TLVTVSS*GGASTKGPSVFPLAPSSKSTSGGTAALGCLVKD YFPEPVTVSWNSGALTSGVHTFPAVLQSSGLYSLSSVVTV PSSSLGTQTYICNVNHKPSNTKVDKKVEPKSCDKTHTCPP CPAPEAAGGPSVFLFPPKPKDTLMISRTPEVTCVVVDVSH EDPEVKFNWYVDGVEVHNAKTKPREEQYNSTYRVVSVLTV LHQDWLNGKEYKCKVSNKALPAPIEKTISKAKGQPREPQV YTLPPSREEMTKNQVSLTCLVKGFYPSDIAVEWESNGQPE NNYKTTPPVLDSDGSFFLYSKLTVDKSRWQQGNVFSCSVM HEALHNHYTQKSLSLSPGK |

TABLE 58-continued

Heavy Chain and Light Chain Amino Acid Sequences of Anti-Human
VEGF-A/Anti-Human PDGF-BB Cross-over DVD-Ig Molecules
(Linker sequence in italics; CDR sequences in bold)

| Seq ID No | Name (Corporate ID) | Sequence |
|---|---|---|
| 220 | CODV006 LC (PR-1565084) | DTQLTQSPSSLSASVGDRVTISCRASESVSTHMHWYQQKP GKAPKLLIYGASNLESGVPSRFSGSGSGTDFTLTISSLQP EDFATYFCQQSWNDPFTFGQGTKVEIK*GGGSGGG*DFQLTQ SPSSLSASVGDRVTITCERSSGDIGDTYVSWYQQKPGKAP KNVIYGNDQRPSGVPSRFSGSGSGNSATLTISSLQPEDFA TYFCQSYDSDIDIVFGQGTKVEIK*GGGSG*RTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 221 | CODV007 HC (PR-1565085) | EVQLVESGGGLVQPGGSLRLSCAASGYTFTNYGMYWVKQA PGKGLEYMGWINTETGKPTYADDFKGRFTFSLDTSKSTAY LQMNSLRAEDTAVYFCARTNYYYRSYIFYFDYWGQGTLVT VSSGEVTLRESGPALVKPTQTLTLTCTFSGFSLSTYGMGV GWIRQPPGKGLEWLANIWWDDDKYYNPSLKNRLTISKDTS KNQAVLTITNMDPVDTATYYCARIESIGTTYSFDYWGQGT MVTVSSGGASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNHYTQKSLSLSPGK |
| 222 | CODV007 LC (PR-1565085) | DFQLTQSPSSLSASVGDRVTITCERSSGDIGDSYVSWYQQ KPGKAPKNVIYADDQRPSGVPSRFSGSGSGNSASLTISSL QPEDFATYFCQSYDINIDIVFGQGTKVEIK*GGGSGGGG*DTQ LTQSPSSLSASVGDRVTISCRASESVSTHMHWYQQKPGKA PKLLIYGASNLESGVPSRFSGSGSGTDFTLTISSLQPEDF ATYFCQQSWNDPFTFGQGTKVEIK*GGGSG*RTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 223 | CODV008 HC (PR-1565086) | EVTLRESGPALVKPTQTLTLTCTFSGFSLSTYGMGVGWIR QPPGKGLEWLANIWWDDDKYYNPSLKNRLTISKDTSKNQA VLTITNMDPVDTATYYCARIESIGTTYSFDYWGQGTMVTV SSGEVQLVESGGGLVQPGGSLRLSCAASGYTFTNYGMYWV KQAPGKGLEYMGWINTETGKPTYADDFKGRFTFSLDTSKS TAYLQMNSLRAEDTAVYFCARTNYYYRSYIFYFDYWGQGT LVTVSSGGASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNHYTQKSLSLSPGK |
| 224 | CODV008 LC (PR-1565086) | DTQLTQSPSSLSASVGDRVTISCRASESVSTHMHWYQQKP GKAPKLLIYGASNLESGVPSRFSGSGSGTDFTLTISSLQP EDFATYFCQQSWNDPFTFGQGTKVEIK*GGGSGGG*DFQLTQ SPSSLSASVGDRVTITCERSSGDIGDSYVSWYQQKPGKAP KNVIYADDQRPSGVPSRFSGSGSGNSASLTISSLQPEDFA TYFCQSYDINIDIVFGQGTKVEIK*GGGSG*RTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 225 | CODV009 HC (PR-1571821) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSSGEVTLRESGPALVKPTQTLTLTCTFSGFSLSTYGMGV GWIRQPPGKALEWLANIWWDDDKYYNPSLKNRLTISKDTS KNQVVLTMTNMDPVDTATYYCARIESIGTTYSFDYWGQGT MVTVSSGGASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL |

TABLE 58-continued

Heavy Chain and Light Chain Amino Acid Sequences of Anti-Human
VEGF-A/Anti-Human PDGF-BB Cross-over DVD-Ig Molecules
(Linker sequence in italics; CDR sequences in bold)

| Seq ID No | Name (Corporate ID) | Sequence 12345678901234567890123456789012345678 90 |
|---|---|---|
| | | HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNAYTQKSLSLSPGK |
| 226 | CODV009 LC (PR-1571821) | EFVLTQSPGTLSLSPGERATLSCERSSGDIGDSYVSWYQQ KPGQAPRLVIYADDQRPSGIPDRFSGSGSGTDFTLTISRL EPEDFAVYYCQSYDINIDIVFGGGTKVEIK*GGGSGGGG*DTV LTQSPATLSLSPGERATLSCRASESVSTHMHWYQQKPGQA PRLLIYGASNLESGVPARFSGSGSGTDFTLTISSLEPEDF AVYFCQQSWNDPFTFGQGTKLEIK*GGGSG*RTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 227 | CODV010 HC (PR-1571823) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV *SS*GEVQLVQSGSELKKPGASVKVSCKASGYTFTNYGMYWV RQAPGQGLEWMGWINTETGKPTYADDFKGRFVFSLDTSVS TAYLQISSLKAEDTAVYYCARTNYYYRSYIFYFDYWGQGT MVTVSS*GGA*STKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNAYTQKSLSLSPGK |
| 228 | CODV010 LC (PR-1571823) | DTVLTQSPATLSLSPGERATLSCRASESVSTHMHWYQQKP GQAPRLLIYGASNLESGVPARFSGSGSGTDFTLTISSLEP EDFAVYFCQQSWNDPFTFGQGTKLEIK*GGGSGGGG*EFVLTQ SPGTLSLSPGERATLSCERSSGDIGDSYVSWYQQKPGQAP RLVIYADDQRPSGIPDRFSGSGSGTDFTLTISRLEPEDFA VYYCQSYDINIDIVFGGGTKVEIK*GGGSG*RTVAAPSVFIF PPSDEQLKSGTASVVCLLNNFYPREAKVQWKVDNALQSGN SQESVTEQDSKDSTYSLSSTLTLSKADYEKHKVYACEVTH QGLSSPVTKSFNRGEC |
| 229 | CODV011 HC (PR-1575521) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGGGS*EFVLTQSPGTLSLSPGERATLSCERSS GDIGDSYVSWYQQKPGQAPRLVIYADDQRPSGIPDRFSGS GSGTDFTLTISRLEPEDFAVYYCQSYDINIDIVFGGGTKV EIK*GGGS*GASTKGPSVFPLAPSSKSTSGGTAALGCLVKDY FPEPVTVSWNSGALTSGVHTFPAVLQSSGLYSLSSVVTVP SSSLGTQTYICNVNHKPSNTKVDKKVEPKSCDKTHTCPPC PAPEAAGGPSVFLFPPKPKDTLMISRTPEVTCVVVDVSHE DPEVKFNWYVDGVEVHNAKTKPREEQYNSTYRVVSVLTVL HQDWLNGKEYKCKVSNKALPAPIEKTISKAKGQPREPQVY TLPPSREEMTKNQVSLTCLVKGFYPSDIAVEWESNGQPEN NYKTTPPVLDSDGSFFLYSKLTVDKSRWQQGNVFSCSVMH EALHNAYTQKSLSLSPGK |
| 230 | CODV011 LC (PR-1575521) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV *SSGGGGSGGGGS*DTVLTQSPATLSLSPGERATLSCRASES VSTHMHWYQQKPGQAPRLLIYGASNLESGVPARFSGSGSG TDFTLTISSLEPEDFAVYFCQQSWNDPFTFGQGTKLEIKG *GGSG*RTVAAPSVFIFPPSDEQLKSGTASVVCLLNNFYPRE AKVQWKVDNALQSGNSQESVTEQDSKDSTYSLSSTLTLSK ADYEKHKVYACEVTHQGLSSPVTKSFNRGEC |
| 231 | CODV012 HC (PR-1571824) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGGG*EFVLTQSPGTLSLSPGERATLSCERSSGD IGDSYVSWYQQKPGQAPRLVIYADDQRPSGIPDRFSGSGS GTDFTLTISRLEPEDFAVYYCQSYDINIDIVFGGGTKVEI |

TABLE 58-continued

Heavy Chain and Light Chain Amino Acid Sequences of Anti-Human VEGF-A/Anti-Human PDGF-BB Cross-over DVD-Ig Molecules
(Linker sequence in italics; CDR sequences in bold)

| Seq ID No | Name (Corporate ID) | Sequence 12345678901234567890123456789012345678 90 |
|---|---|---|
| | | K*GGGSG*ASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVDVSHEDP EVKFNWYVDGVEVHNAKTKPREEQYNSTYRVVSVLTVLHQ DWLNGKEYKCKVSNKALPAPIEKTISKAKGQPREPQVYTL PPSREEMTKNQVSLTCLVKGFYPSDIAVEWESNGQPENNY KTTPPVLDSDGSFFLYSKLTVDKSRWQQGNVFSCSVMHEA LHNAYTQKSLSLSPGK |
| 232 | CODV012 LC (PR-1571824) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGSGGG*DTVLTQSPATLSLSPGERATLSCRASESVS THMHWYQQKPGQAPRLLIYGASNLESGVPARFSGSGSGTD FTLTISSLEPEDFAVYFCQQSWNDPFTFGQGTKLEIK*GGG SG*RTVAAPSVFIFPPSDEQLKSGTASVVCLLNNFYPREAK VQWKVDNALQSGNSQESVTEQDSKDSTYSLSSTLTLSKAD YEKHKVYACEVTHQGLSSPVTKSFNRGEC |
| 233 | CODV013 HC (PR-1571825) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGG*EFVLTQSPGTLSLSPGERATLSCERSSGD IGDSYVSWYQQKPGQAPRLVIYADDQRPSGIPDRFSGSGS GTDFTLTISRLEPEDFAVYYCQSYDINIDIVFGGGTKVEI K*GGSA*STKGPSVFPLAPSSKSTSGGTAALGCLVKDYFPEP VTVSWNSGALTSGVHTFPAVLQSSGLYSLSSVVTVPSSSL GTQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQDW LNGKEYKCKVSNKALPAPIEKTISKAKGQPREPQVYTLPP SREEMTKNQVSLTCLVKGFYPSDIAVEWESNGQPENNYKT TPPVLDSDGSFFLYSKLTVDKSRWQQGNVFSCSVMHEALH NAYTQKSLSLSPGK |
| 234 | CODV013 LC (PR-1571825) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGSGGG*DTVLTQSPATLSLSPGERATLSCRASESVS THMHWYQQKPGQAPRLLIYGASNLESGVPARFSGSGSGTD FTLTISSLEPEDFAVYFCQQSWNDPFTFGQGTKLEIK*GGG SG*RTVAAPSVFIFPPSDEQLKSGTASVVCLLNNFYPREAK VQWKVDNALQSGNSQESVTEQDSKDSTYSLSSTLTLSKAD YEKHKVYACEVTHQGLSSPVTKSFNRGEC |
| 235 | CODV014 HC (PR-1571826) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGS*EFVLTQSPGTLSLSPGERATLSCERSSGDIGD SYVSWYQQKPGQAPRLVIYADDQRPSGIPDRFSGSGSGTD FTLTISRLEPEDFAVYYCQSYDINIDIVFGGGTKVEIK*GG SA*STKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAAG GPSVFLFPPKPKDTLMISRTPEVTCVVVDVSHEDPEVKFN WYVDGVEVHNAKTKPREEQYNSTYRVVSVLTVLHQDWLNG KEYKCKVSNKALPAPIEKTISKAKGQPREPQVYTLPPSRE EMTKNQVSLTCLVKGFYPSDIAVEWESNGQPENNYKTTPP VLDSDGSFFLYSKLTVDKSRWQQGNVFSCSVMHEALHNAY TQKSLSLSPGK |
| 236 | CODV014 LC (PR-1571826) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGSGGG*DTVLTQSPATLSLSPGERATLSCRASESVS THMHWYQQKPGQAPRLLIYGASNLESGVPARFSGSGSGTD FTLTISSLEPEDFAVYFCQQSWNDPFTFGQGTKLEIK*GGG SG*RTVAAPSVFIFPPSDEQLKSGTASVVCLLNNFYPREAK VQWKVDNALQSGNSQESVTEQDSKDSTYSLSSTLTLSKAD YEKHKVYACEVTHQGLSSPVTKSFNRGEC |

TABLE 58-continued

Heavy Chain and Light Chain Amino Acid Sequences of Anti-Human
VEGF-A/Anti-Human PDGF-BB Cross-over DVD-Ig Molecules
(Linker sequence in italics; CDR sequences in bold)

| Seq ID No | Name (Corporate ID) | Sequence |
|---|---|---|
| 237 | CODV015 HC (PR-1571827) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGG*EFVLTQSPGTLSLSPGERATLSCERSSGD IGDSYVSWYQQKPGQAPRLVIYADDQRPSGIPDRFSGSGS GTDFTLTISRLEPEDFAVYYCQSYDINIDIVFGGGTKVEI K*GGGSG*ASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVDVSHEDP EVKFNWYVDGVEVHNAKTKPREEQYNSTYRVVSVLTVLHQ DWLNGKEYKCKVSNKALPAPIEKTISKAKGQPREPQVYTL PPSREEMTKNQVSLTCLVKGFYPSDIAVEWESNGQPENNY KTTPPVLDSDGSFFLYSKLTVDKSRWQQGNVFSCSVMHEA LHNAYTQKSLSLSPGK |
| 238 | CODV015 LC (PR-1571827) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMTV SS*GGGGSGGG*DTVLTQSPATLSLSPGERATLSCRASESVS THMHWYQQKPGQAPRLLIYGASNLESGVPARFSGSGSGTD FTLTISSLEPEDFAVYFCQQSWNDPFTFGQGTKLEIK*GGS* RTVAAPSVFIFPPSDEQLKSGTASVVCLLNNFYPREAKVQ WKVDNALQSGNSQESVTEQDSKDSTYSLSSTLTLSKADYE KHKVYACEVTHQGLSSPVTKSFNRGEC |
| 239 | CODV016 HC (PR-1571828) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGG*EFVLTQSPGTLSLSPGERATLSCERSSGD IGDSYVSWYQQKPGQAPRLVIYADDQRPSGIPDRFSGSGS GTDFTLTISRLEPEDFAVYYCQSYDINIDIVFGGGTKVEI K*GGGSG*ASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVDVSHEDP EVKFNWYVDGVEVHNAKTKPREEQYNSTYRVVSVLTVLHQ DWLNGKEYKCKVSNKALPAPIEKTISKAKGQPREPQVYTL PPSREEMTKNQVSLTCLVKGFYPSDIAVEWESNGQPENNY KTTPPVLDSDGSFFLYSKLTVDKSRWQQGNVFSCSVMHEA LHNAYTQKSLSLSPGK |
| 240 | CODV016 LC (PR-1571828) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGS*DTVLTQSPATLSLSPGERATLSCRASESVSTHM HWYQQKPGQAPRLLIYGASNLESGVPARFSGSGSGTDFTL TISSLEPEDFAVYFCQQSWNDPFTFGQGTKLEIK*GGS*RTV AAPSVFIFPPSDEQLKSGTASVVCLLNNFYPREAKVQWKV DNALQSGNSQESVTEQDSKDSTYSLSSTLTLSKADYEKHK VYACEVTHQGLSSPVTKSFNRGEC |
| 241 | CODV017 HC (PR-1571830) | DTVLTQSPATLSLSPGERATLSCRASESVSTHMHWYQQKP GQAPRLLIYGASNLESGVPARFSGSGSGTDFTLTISSLEP EDFAVYFCQQSWNDPFTFGQGTKLEIK*GGGSGGGG*EFVLTQ SPGTLSLSPGERATLSCERSSGDIGDSYVSWYQQKPGQAP RLVIYADDQRPSGIPDRFSGSGSGTDFTLTISRLEPEDFA VYYCQSYDINIDIVFGGGTKVEIK*GGGSG*ASTKGPSVFPL APSSKSTSGGTAALGCLVKDYFPEPVTVSWNSGALTSGVH TFPAVLQSSGLYSLSSVVTVPSSSLGTQTYICNVNHKPSN TKVDKKVEPKSCDKTHTCPPCPAPEAAGGPSVFLFPPKPK DTLMISRTPEVTCVVVDVSHEDPEVKFNWYVDGVEVHNAK TKPREEQYNSTYRVVSVLTVLHQDWLNGKEYKCKVSNKAL PAPIEKTISKAKGQPREPQVYTLPPSREEMTKNQVSLTCL VKGFYPSDIAVEWESNGQPENNYKTTPPVLDSDGSFFLYS KLTVDKSRWQQGNVFSCSVMHEALHNAYTQKSLSLSPGK |
| 242 | CODV017 LC (PR-1571830) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GEVQLVQSGSELKKPGASVKVSCKAS*GYTFTNYGMYWV RQAPGQGLEWMGWINTETGKPTYADDFKGRFVFSLDTSVS |

TABLE 58-continued

Heavy Chain and Light Chain Amino Acid Sequences of Anti-Human
VEGF-A/Anti-Human PDGF-BB Cross-over DVD-Ig Molecules
(Linker sequence in italics; CDR sequences in bold)

| Seq ID No | Name (Corporate ID) | Sequence |
|---|---|---|
| | | TAYLQISSLKAEDTAVYYCARTNYYYRSYIFYFDYWGQGT MVTVSS*GGRT*VAAPSVFIFPPSDEQLKSGTASVVCLLNNF YPREAKVQWKVDNALQSGNSQESVTEQDSKDSTYSLSSTL TLSKADYEKHKVYACEVTHQGLSSPVTKSFNRGEC |
| 243 | CODV018 HC (PR-1571831) | EFVLTQSPGTLSLSPGERATLSCERSSGDIGDSYVSWYQQ KPGQAPRLVIYADDQRPSGIPDRFSGSGSGTDFTLTISRL EPEDFAVYYCQSYDINIDIVFGGGTKVEIK*GGGSGGGG*DTV LTQSPATLSLSPGERATLSCRASESVSTHMHWYQQKPGQA PRLLIYGASNLESGVPARFSGSGSGTDFTLTISSLEPEDF AVYFCQQSWNDPFTFGQGTKLEIK*GGGS*GASTKGPSVFPL APSSKSTSGGTAALGCLVKDYFPEPVTVSWNSGALTSGVH TFPAVLQSSGLYSLSSVVTVPSSSLGTQTYICNVNHKPSN TKVDKKVEPKSCDKTHTCPPCPAPEAAGGPSVFLFPPKPK DTLMISRTPEVTCVVVDVSHEDPEVKFNWYVDGVEVHNAK TKPREEQYNSTYRVVSVLTVLHQDWLNGKEYKCKVSNKAL PAPIEKTISKAKGQPREPQVYTLPPSREEMTKNQVSLTCL VKGFYPSDIAVEWESNGQPENNYKTTPPVLDSDGSFFLYS KLTVDKSRWQQGNVFSCSVMHEALHNAYTQKSLSLSPGK |
| 244 | CODV018 LC (PR-1571831) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GEVTLRESGPALVKPTQTLTLTCTFS*GFSLSTYGMGV GWIRQPPGKALEWLANIWWDDDKYYNPSLKNRLTISKDTS KNQVVLTMTNMDPVDTATYYCARIESIGTTYSFDYWGQGT MVTVSS*GGRT*VAAPSVFIFPPSDEQLKSGTASVVCLLNNF YPREAKVQWKVDNALQSGNSQESVTEQDSKDSTYSLSSTL TLSKADYEKHKVYACEVTHQGLSSPVTKSFNRGEC |
| 245 | CODV019 HC (PR-1571832) | DTVLTQSPATLSLSPGERATLSCRASESVSTHMHWYQQKP GQAPRLLIYGASNLESGVPARFSGSGSGTDFTLTISSLEP EDFAVYFCQQSWNDPFTFGQGTKLEIK*GGGSGGGG*EVTLR ESGPALVKPTQTLTLTCTFSGFSLSTYGMGVGWIRQPPGK ALEWLANIWWDDDKYYNPSLKNRLTISKDTSKNQVVLTMT NMDPVDTATYYCARIESIGTTYSFDYWGQGTMVTVSS*LGG CGGGS*ASTKGPSVFPLAPSSKSTSGGTAALGCLVKDYFPE PVTVSWNSGALTSGVHTFPAVLQSSGLYSLSSVVTVPSSS LGTQTYICNVNHKPSNTKVDKKVEPKSCDKTHTCPPCPAP EAAGGPSVFLFPPKPKDTLMISRTPEVTCVVVDVSHEDPE VKFNWYVDGVEVHNAKTKPREEQYNSTYRVVSVLTVLHQD WLNGKEYKCKVSNKALPAPIEKTISKAKGQPREPQVYTLP PSREEMTKNQVSLTCLVKGFYPSDIAVEWESNGQPENNYK TTPPVLDSDGSFFLYSKLTVDKSRWQQGNVFSCSVMHEAL HNAYTQKSLSLSPGK |
| 246 | CODV019 LC (PR-1571832) | EFVLTQSPGTLSLSPGERATLSCERSSGDIGDSYVSWYQQ KPGQAPRLVIYADDQRPSGIPDRFSGSGSGTDFTLTISRL EPEDFAVYYCQSYDINIDIVFGGGTKVEIK*GGGSGGGG*EV QLVQSGSELKKPGASVKVSCKASGYTFTNYGMYWVRQAPG QGLEWMGWINTETGKPTYADDFKGRFVFSLDTSVSTAYLQ ISSLKAEDTAVYYCARTNYYYRSYIFYFDYWGQGTMVTVS *SLGGCGGGS*RTVAAPSVFIFPPSDEQLKSGTASVVCLLNN FYPREAKVQWKVDNALQSGNSQESVTEQDSKDSTYSLSST LTLSKADYEKHKVYACEVTHQGLSSPVTKSFNRGEC |
| 247 | CODV020 HC (PR-1571836) | EFVLTQSPGTLSLSPGERATLSCERSSGDIGDSYVSWYQQ KPGQAPRLVIYADDQRPSGIPDRFSGSGSGTDFTLTISRL EPEDFAVYYCQSYDINIDIVFGGGTKVEIK*GGGSGGGG*EV QLVQSGSELKKPGASVKVSCKASGYTFTNYGMYWVRQAPG QGLEWMGWINTETGKPTYADDFKGRFVFSLDTSVSTAYLQ ISSLKAEDTAVYYCARTNYYYRSYIFYFDYWGQGTMVTVS *SLGGCGGGS*ASTKGPSVFPLAPSSKSTSGGTAALGCLVKD YFPEPVTVSWNSGALTSGVHTFPAVLQSSGLYSLSSVVTV PSSSLGTQTYICNVNHKPSNTKVDKKVEPKSCDKTHTCPP CPAPEAAGGPSVFLFPPKPKDTLMISRTPEVTCVVVDVSH EDPEVKFNWYVDGVEVHNAKTKPREEQYNSTYRVVSVLTV LHQDWLNGKEYKCKVSNKALPAPIEKTISKAKGQPREPQV YTLPPSREEMTKNQVSLTCLVKGFYPSDIAVEWESNGQPE NNYKTTPPVLDSDGSFFLYSKLTVDKSRWQQGNVFSCSVM HEALHNAYTQKSLSLSPGK |

TABLE 58-continued

Heavy Chain and Light Chain Amino Acid Sequences of Anti-Human VEGF-A/Anti-Human PDGF-BB Cross-over DVD-Ig Molecules
(Linker sequence in italics; CDR sequences in bold)

| Seq ID No | Name (Corporate ID) | Sequence |
|---|---|---|
| 248 | CODV020 LC (PR-1571836) | DTVLTQSPATLSLSPGERATLSCRASESVSTHMHWYQQKP GQAPRLLIYGASNLESGVPARFSGSGSGTDFTLTISSLEP EDFAVYFCQQSWNDPFTFGQGTKLEIK*GGGSGGGG*EVTLR ESGPALVKPTQTLTLTCTFSGFSLSTYGMGVGWIRQPPGK ALEWLANIWWDDDKYYNPSLKNRLTISKDTSKNQVVLTMT NMDPVDTATYYCARIESIGTTYSFDYWGQGTMVTVSS*LGG CGGGGS*RTVAAPSVFIFPPSDEQLKSGTASVVCLLNNFYPR EAKVQWKVDNALQSGNSQESVTEQDSKDSTYSLSSTLTLS KADYEKHKVYACEVTHQGLSSPVTKSFNRGEC |
| 249 | CODV021 HC (PR-1577053) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGGG*EFVLTQSPGTLSLSPGERATLSCERSSGD IGESYVSWYQQKPGQAPRLVIYADDQRPSGIPDRFSGSGS GTDFTLTISRLEPEDFAVYYCQSYDINIDIVFGGGTKVEI K*GGGGS*GASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVDVSHEDP EVKFNWYVDGVEVHNAKTKPREEQYNSTYRVVSVLTVLHQ DWLNGKEYKCKVSNKALPAPIEKTISKAKGQPREPQVYTL PPSREEMTKNQVSLTCLVKGFYPSDIAVEWESNGQPENNY KTTPPVLDSDGSFFLYSKLTVDKSRWQQGNVFSCSVMHEA LHNHYTQKSLSLSPGK |
| 250 | CODV021 LC (PR-1577053) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGSGGGG*DTVLTQSPATLSLSPGERATLSCRASESVS THMHWYQQKPGQAPRLLIYGASNLESGVPARFSGSGSGTD FTLTISSLEPEDFAVYFCQQSWNDPFTFGQGTKLEIK*GGS* RTVAAPSVFIFPPSDEQLKSGTASVVCLLNNFYPREAKVQ WKVDNALQSGNSQESVTEQDSKDSTYSLSSTLTLSKADYE KHKVYACEVTHQGLSSPVTKSFNRGEC |
| 251 | CODV022 HC (PR-1577056) | EVQLVQSGSELKKPGASVKVSCKASGYTFTNYGMYWVRQA PGQGLEWMGWINTETGKPTYADDFKGRFVFSLDTSVSTAY LQISSLKAEDTAVYYCARTNYYYRSYIFYFDYWGQGTMVT VSS*GGGGSGGGG*EFVLTQSPGTLSLSPGERATLSCERSSGD IGESYVSWYQQKPGQAPRLVIYADDQRPSGIPDRFSGSGS GTDFTLTISRLEPEDFAVYYCQSYDINIDIVFGGGTKVEI K*GGGGS*GASTKGPSVFPLAPSSKSTSGGTAALGCLVKDYFP EPVTVSWNSGALTSGVHTFPAVLQSSGLYSLSSVVTVPSS SLGTQTYICNVNHKPSNTKVDKKVEPKSCDKTHTCPPCPA PEAAGGPSVFLFPPKPKDTLMISRTPEVTCVVVDVSHEDP EVKFNWYVDGVEVHNAKTKPREEQYNSTYRVVSVLTVLHQ DWLNGKEYKCKVSNKALPAPIEKTISKAKGQPREPQVYTL PPSREEMTKNQVSLTCLVKGFYPSDIAVEWESNGQPENNY KTTPPVLDSDGSFFLYSKLTVDKSRWQQGNVFSCSVMHEA LHNHYTQKSLSLSPGK |
| 252 | CODV022 LC (PR-1577056) | EVTLRESGPALVKPTQTLTLTCTFSGFSLSTYGMGVGWIR QPPGKALEWLANIWWDDDKYYNPSLKNRLTISKDTSKNQV VLTMTNMDPVDTATYYCARIESIGTTYSFDYWGQGTMVTV SS*GGGGS*DTVLTQSPATLSLSPGERATLSCRASESVSTHM HWYQQKPGQAPRLLIYGASNLESGVPARFSGSGSGTDFTL TISSLEPEDFAVYFCQQSWNDPFTFGQGTKLEIK*GGS*RTV AAPSVFIFPPSDEQLKSGTASVVCLLNNFYPREAKVQWKV DNALQSGNSQESVTEQDSKDSTYSLSSTLTLSKADYEKHK VYACEVTHQGLSSPVTKSFNRGEC |

Example 12: Generation of scFv-IgG Fusion Proteins

All Ig-scFv molecules used the same anti-VEGF-A mAb AB014 as the IgG molecule. A single chain Fv (scFv) anti-PDGF-BB antibody was fused to the C-terminus of AB014 heavy chain using various length of GS linker using standard molecular cloning techniques. Four different heavy chains and one common light chain were made, as shown in the table below. Each heavy chain and the common light chain were co-transfected into HEK293 cells and the resulting Ig-scFv fusion proteins were purified using rProtein-A chromatography.

TABLE 59

Heavy Chain and Light Chain Amino Acid Sequences of Anti-human VEGF-A/anti-human PDGF-BB Ig-scFv Molecules
(Linker sequence in italics; CDR sequences in bold)

| Seq ID No | Name (Corporate ID) | Sequence<br>12345678901234567890123456789012345678 90 |
|---|---|---|
| 3839 | AB014-GS6-9E8.4 VH-VK HC (PR-1599234) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQDWL NGKEYKCKVSNKALPAPIEKTISKAKGQPREPQVYTLPPS REEMTKNQVSLTCLVKGFYPSDIAVEWESNGQPENNYKTT PPVLDSDGSFFLYSKLTVDKSRWQQGNVFSCSVMHEALHN AYTQKSLSLSPGK*GGSGGGG*EVTLRESGPALVKPTQTLTLT CTFSGFSLSTYGMGVGWIRQPPGKALEWLANIWWDDDKYY NPSLKNRLTISKDTSKNQVVLTMTNMDPVDTATYYCARIE SIGTTYSFDYWGQGTMVTVS*SGGGGSGGGGSGGGGS*EIVL TQSPGTLSLSPGERATLSCERSSGDIGDSYVSWYQQKPGQ APRLVIYADDQRPSGIPDRFSGSGSGTDFTLTISRLEPED FAVYYCQSYDINIDIVFGGGTKVEIK |
| 3940 | AB014-GS10-9E8.4 VH-VK HC (PR-1599236) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQDWL NGKEYKCKVSNKALPAPIEKTISKAKGQPREPQVYTLPPS REEMTKNQVSLTCLVKGFYPSDIAVEWESNGQPENNYKTT PPVLDSDGSFFLYSKLTVDKSRWQQGNVFSCSVMHEALHN AYTQKSLSLSPGK*GGSGGGGSGG*EVTLRESGPALVKPTQT LTLTCTFSGFSLSTYGMGVGWIRQPPGKALEWLANIWWDD DKYYNPSLKNRLTISKDTSKNQVVLTMTNMDPVDTATYYC ARIESIGTTYSFDYWGQGTMVTVS*SGGGGSGGGGSGGGGS* EIVLTQSPGTLSLSPGERATLSCERSSGDIGDSYVSWYQQ KPGQAPRLVIYADDQRPSGIPDRFSGSGSGTDFTLTISRL EPEDFAVYYCQSYDINIDIVFGGGTKVEIK |
| 3841 | AB014-GS15-9E8.4 VH-VK HC (PR-1599239) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQDWL NGKEYKCKVSNKALPAPIEKTISKAKGQPREPQVYTLPPS REEMTKNQVSLTCLVKGFYPSDIAVEWESNGQPENNYKTT PPVLDSDGSFFLYSKLTVDKSRWQQGNVFSCSVMHEALHN AYTQKSLSLSPGK*GGSGGGGSGGGGSGG*EVTLRESGPALV KPTQTLTLTCTFSGFSLSTYGMGVGWIRQPPGKALEWLA IWWDDDKYYNPSLKNRLTISKDTSKNQVVLTMTNMDPVDT ATYYCARIESIGTTYSFDYWGQGTMVTVS*SGGGGSGGGGS GGGGS*EIVLTQSPGTLSLSPGERATLSCERSSGDIGDSYV SWYQQKPGQAPRLVIYADDQRPSGIPDRFSGSGSGTDFTL TISRLEPEDFAVYYCQSYDINIDIVFGGGTKVEIK |
| 3842 | AB014-GS10-9E8.4 VK-VH HC (PR-1599240) | EVQLVESGGGLVQPGGSLRLSCAASGYTFTNYGMNWVRQA PGKGLEWVGWINTYTGEPTYAADFKRRFTFSLDTSKSTAY LQMNSLRAEDTAVYYCAKYPHYYGSSHWYFDVWGQGTLVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQDWL NGKEYKCKVSNKALPAPIEKTISKAKGQPREPQVYTLPPS REEMTKNQVSLTCLVKGFYPSDIAVEWESNGQPENNYKTT PPVLDSDGSFFLYSKLTVDKSRWQQGNVFSCSVMHEALHN AYTQKSLSLSPGK*GGSGGGGSGG*EIVLTQSPGTLSLSPGE RATLSCERSSGDIGDSYVSWYQQKPGQAPRLVIYADDQRP SGIPDRFSGSGSGTDFTLTISRLEPEDFAVYYCQSYDINI DIVFGGGTKVEIK*GGGGSGGGGSGGGGS*EVTLRESGPALV KPTQTLTLTCTFSGFSLSTYGMGVGWIRQPPGKALEWLAN |

TABLE 59-continued

Heavy Chain and Light Chain Amino Acid Sequences of Anti-human VEGF-A/anti-human PDGF-BB Ig-scFv Molecules
(Linker sequence in italics; CDR sequences in bold)

| Seq ID No | Name (Corporate ID) | Sequence 12345678901234567890123456789012345678900 |
|---|---|---|
| | | IWWDDDKYYNPSLKNRLTISKDTSKNQVVLTMTNMDPVDT ATYYCARIESIGTTYSFDYWGQGTMVTVSS |
| 3843 | AB014 LC | DIQMTQSPSSLSASVGDRVTITCSASQDISNYLNWYQQKP GKAPKVLIYFTSSLHSGVPSRFSGSGSGTDFTLTISSLQP EDFATYYCQQYSTVPWTFGQGTKVEIKRTVAAPSVFIFPP SDEQLKSGTASVVCLLNNFYPREAKVQWKVDNALQSGNSQ ESVTEQDSKDSTYSLSSTLTLSKADYEKHKVYACEVTHQG LSSPVTKSFNRGEC |

All HC use the exact same LC (last sequence in Table 59). The naming of the HC follows the following convention: VH name—Linker length (between Fc and scFv)—scFv name with orientation of scFv.

Example 13: In Vitro Characterization of Anti-VEGF-A/Anti-PDGF-BB DVD-Ig Molecules and Other Bispecific Molecules

Example 13.1: Expression and Purification of Anti-VEGF-A/Anti-PDGF-BB DVD-Ig Molecules and CO-DVD-Ig Molecules All variants were transiently transfected into 200-500 mls of HEK 293 6e suspension cell cultures in a ratio of 60% to 40% light to heavy chain construct. 1 mg/ml PEI was used to transfect the cells. Alternatively variants were transiently transfected into 500 mls of Expi293 suspension cell cultures using the ExpiFectamine kit (LifeTechnologies A14524). Supernatants were harvested after six days in shaking flasks, spun down to pellet cells, and filtered through 0.22 μm filters to separate IgG from culture contaminates. All was purified via gravity flow using 1-2 ml of rProteinA sepharose fast flow beads (GE Healthcare, 17-1279-04) over poly prep chromatography columns (Bio Rad, 731-1550). Once supernatants had passed through the columns the beads were washed with 10 column volumes of binding buffer, and IgG was eluted with Immunopure IgG elution buffer (Pierce, 185 1520) and collected in 1 ml aliquots. Fractions containing DVD-Ig were pooled and dialyzed in PBS or 15 mM Histidine pH 6 overnight at 4° C.

TABLE 60

Expression Level and SEC Profile of Anti-VEGF-A/Anti-PDGF-BB DVD-Ig, CO-DVD-Ig and IgG-scFv Fusion Proteins

| Name | Corporate ID | Octet Titer (mg/L) | Yield (mg/L) | SEC (% monomer) |
|---|---|---|---|---|
| AB014-GS-9E8.4 | NA | 4.2 | ND | ND |
| 9E8.4-GS-AB014 | NA | 1.2 | ND | ND |
| AB014-SS-9E8.4 | NA | 3.5 | 0.4 | ND |
| 9E8.4-SS-AB014 | NA | 3.5 | 0.6 | ND |
| AB014-SL-9E8.4 | NA | 2.0 | ND | ND |
| 9E8.4-SL-AB014 | NA | 2.8 | 0.1 | ND |
| AB014-LS-9E8.4 | NA | 3.3 | ND | ND |
| 9E8.4-LS-AB014 | NA | 3.6 | ND | ND |
| 9E8.4-GS-4G8.3 | PR-1563988 | 6.5 | 2.8 | 94.5 |
| 9E8.4-SS-4G8.3 | PR-1563990 | 5.9 | 4.5 | 92.1 |
| 9E8.4-SL-4G8.3 | PR-1563998 | 3.4 | 2.0 | 94.0 |
| 9E8.4-LS-4G8.3 | PR-1564009 | 10.7 | 8.0 | 93.3 |
| 4G8.3-GS-9E8.4 | PR-1564010 | 3.6 | 2.1 | 98.4 |
| 4G8.3-SS-9E8.4 | PR-1564011 | 5.7 | 3.1 | 99.4 |
| 4G8.3-SL-9E8.4 | PR-1564012 | 2.6 | 0.7 | 99.4 |
| 4G8.3-LS-9E8.4 | PR-1564013 | 6.7 | 3.1 | 99.2 |
| DVD3896 | PR-1564883 | ND | 2.8 | 100.0 |
| DVD3897 | PR-1564893 | ND | 2.7 | 79.1 |
| DVD3898 | PR-1564896 | ND | 22.0 | 93.0 |
| DVD3899 | PR-1564898 | ND | 14.7 | 87.4 |
| DVD3900 | PR-1564899 | ND | 12.1 | 72.4 |
| DVD3901 | PR-1565023 | ND | 1.3 | 99.1 |
| DVD3902 | PR-1565029 | ND | 3.2 | 98.3 |
| DVD3903 | PR-1565030 | ND | 2.9 | 98.0 |
| DVD3904 | PR-1565031 | ND | 13.8 | 97.8 |
| DVD3905 | PR-1565032 | ND | 15.1 | 92.5 |
| DVD3906 | PR-1565035 | ND | 28.2 | 85.5 |
| DVD3907 | PR-1565033 | ND | 0.5 | ND |
| CODV001 | PR-1565040 | ND | 88.4 | 87.6 |
| CODV002 | PR-1565042 | ND | 46.5 | 97.0 |
| CODV003 | PR-1565044 | ND | 37.3 | 77.3 |
| CODV004 | PR-1565051 | ND | 75.8 | 77.4 |
| CODV005 | PR-1565083 | ND | 104.5 | 86.9 |
| CODV006 | PR-1565084 | ND | 83.9 | 96.4 |
| CODV007 | PR-1565085 | ND | 43.9 | 77.4 |
| CODV008 | PR-1565086 | ND | 44.5 | 75.5 |
| CODV009 | PR-1571821 | 2.0 | 1.2 | 86.6 |
| CODV010 | PR-1571823 | 4.5 | 3.6 | 94.8 |
| CODV011 | PR-1575521 | 3.7 | 2.0 | 100.0 |
| CODV012 | PR-1571824 | 2.0 | 0.7 | 98.9 |
| CODV013 | PR-1571825 | 0.7 | 0.4 | 90.6 |
| CODV014 | PR-1571826 | 4.5 | 0.5 | 89.6 |
| CODV015 | PR-1571827 | 0.7 | 0.9 | 91.7 |
| CODV016 | PR-1571828 | 2.6 | 1.4 | 93.6 |
| CODV017 | PR-1571830 | 4.2 | 2.6 | 99.8 |
| CODV018 | PR-1571831 | 2.6 | 1.5 | 88.8 |
| CODV019 | PR-1571832 | 0.4 | 0.2 | 87.1 |
| CODV020 | PR-1571836 | 2.1 | 0.3 | 58.1 |
| 4G8.3-GS-9E8.4 | PR-1569574 | 4.4 | 4.3 | ND |
| 4G8.3-SL-9E8.4 | PR-1569579 | 0.7 | 0.5 | ND |
| 4G8.3-LS-9E8.4 | PR-1575573 | 3.8 | 2.7 | ND |
| 4G8.3-GS-9E8.4 (g) | PR-1572102 | 2.5 | 0.4 | 98.8 |
| 4G8.3-GS(11)-9E8.4 (g) | PR-1572103 | 5.3 | 1.4 | 100.0 |
| 4G8.3-GS(noR)-9E8.4 (g) | PR-1572104 | 4.1 | 0.7 | 99.5 |
| 4G8.3-SL-9E8.4 (g) | PR-1572105 | 1.4 | 0.3 | 98.6 |
| 4G8.3-LS-9E8.4 (g) | PR-1572106 | 4.0 | 0.8 | 100.0 |
| 4G8.3-GS-9E8.4E | PR-1575832 | 9.8 | 8.1 | 99.2 |
| 4G8.3-SL-9E8.4E | PR-1575834 | 4.5 | 2.6 | 99.0 |
| 4G8.3-LS-9E8.4E | PR-1575835 | 16.0 | 9.7 | 99.6 |
| CODV021 | PR-1577053 | 2.6 | 0.3 | 92.8 |
| CODV022 | PR-1577056 | 2.0 | 0.2 | 93.2 |
| 9A8.12-GS-9E8.4E | PR-1577165 | 3.3 | 2.4 | 82.99 |
| 9A8.12-SL-9E8.4E | PR-1577166 | 1.1 | 0.2 | 51.54 |

TABLE 60-continued

Expression Level and SEC Profile of Anti-VEGF-A/Anti-PDGF-BB DVD-Ig, CO-DVD-Ig and IgG-scFv Fusion Proteins

| Name | Corporate ID | Octet Titer (mg/L) | Yield (mg/L) | SEC (% monomer) |
|---|---|---|---|---|
| 9A8.12-LS-9E8.4E | PR-1577547 | 10.6 | 1.1 | 97.35 |
| 9E8.4E-GS-9A8.12 | PR-1578137 | 12.0 | 3.8 | 97.3 |
| 9E8.4E-SL-9A8.12 | PR-1577548 | 5.0 | 1.7 | 97.51 |
| 9E8.4E-LS-9A8.12 | PR-1577550 | 2.5 | 2.5 | 96.96 |
| AB014-GS6-9E8.4 VH-VK | PR-1599234 | 70.0 | 25.6 | 33.8 |
| AB014-GS10-9E8.4 VH-VK | PR-1599236 | 70.0 | 24.3 | 34.7 |
| AB014-GS15-9E8.4 VH-VK | PR-1599239 | 70.0 | 29.3 | 39.3 |
| AB014-GS10-9E8.4 VK-VH | PR-1599240 | 47.0 | 21.4 | 33.2 |
| 4G8.2-GS-9E8.4 | PR-1598261 | 29.4 | 10.3 | 98.31 |
| 4G8.4-GS-9E8.4 | PR-1598262 | 61.0 | 20.4 | 87.65 |
| 4G8.5-GS-9E8.4 | PR-1598263 | 31.3 | 11.5 | 98.5 |
| 4G8.12-GS-9E8.4 | PR-1598264 | 44.0 | 15.1 | 93.12 |
| 4G8.13-GS-9E8.4 | PR-1598265 | 6.3 | 2.6 | 83.58 |
| 4G8.14-GS-9E8.4 | PR-1598266 | 19.3 | 9.9 | 96.52 |
| CL-34565_GS_CL-33675 | PR-1613183 | 101.4 | 27.7 | 88.2 |
| CL-34565_GS_9E8.4 | PR-1613184 | 49.3 | 31.3 | 95.9 |
| CL-34565_GS_3E2.1 | PR-1613185 | 109.8 | 82.5 | 96.3 |
| 4G8.5_GS_CL-33675 | PR-1611291 | 91.1 | 10.4 | 96.9 |
| 4G8.5_GS_9E8.4 | PR-1612489 | 39.0 | 23.0 | 97.0 |
| 4G8.5_GS_3E2.1 | PR-1610560 | 127.0 | 13.9 | 100.0 |
| 9E10.1_GS_CL-33675 | PR-1610561 | 136.0 | 19.2 | 92.9 |
| 9E10.1_GS_9E8.4 | PR-1612491 | 86.0 | 50.1 | 95.0 |
| 9E10.1_GS_3E2.1 | PR-1610562 | 44.0 | 10.2 | 96.0 |
| 9E10.6_GS_CL-33675 | PR-1612492 | 152.0 | 65.7 | 89.0 |
| 9E10.6_GS_9E8.4 | PR-1612493 | 96.0 | 50.1 | 93.0 |
| 9E10.6_GS_3E2.1 | PR-1610563 | 122.0 | 18.0 | 95.0 |
| 1B10.1_GS_CL-33675 | PR-1611292 | 233.0 | 22.7 | 75.4 |
| 1B10.1_GS_9E8.4 | PR-1612494 | 123.0 | 52.1 | 77.0 |
| 1B10.1_GS_3E2.1 | PR-1610564 | 142.0 | 23.3 | 93.7 |
| 1E3.4_GS_CL-33675 | PR-1611293 | 54.0 | 9.3 | 83.7 |
| 1E3.4_GS_9E8.4 | PR-1611294 | 67.5 | 11.6 | 72.1 |
| 1E3.4_GS_3E2.1 | PR-1612495 | 101.0 | 29.6 | 97.0 |
| CL-33675_GS_CL-34565 | PR-1613186 | 73.5 | 17.7 | 87.6 |
| CL-33675_GS_4G8.5 | PR-1612496 | 36.0 | 8.6 | 94.0 |
| CL-33675_GS_9E10.1 | PR-1611295 | 148.5 | 2.3 | 95.9 |
| CL-33675_GS_9E10.6 | PR-1611296 | 185.3 | 4.9 | 95.8 |
| CL-33675_GS_1B10.1 | PR-1612498 | 19.0 | 7.0 | 65.0 |
| CL-33675_GS_1E3.4 | PR-1611297 | 72.8 | 3.5 | 95.9 |
| 9E8.4_GS_CL-34565 | PR-1613187 | 67.5 | 53.6 | 79.0 |
| 9E8.4_GS_4G8.5 | PR-1613188 | 95.2 | 73.6 | 81.7 |
| 9E8.4_GS_9E10.1 | PR-1611298 | 237.5 | 21.5 | 73.3 |
| 9E8.4_GS_9E10.6 | PR-1611299 | 179.0 | 19.1 | 71.9 |
| 9E8.4_GS_1B10.1 | PR-1611300 | 93.7 | 12.9 | 71.7 |
| 9E8.4_GS_1E3.4 | PR-1611301 | 87.9 | 12.2 | 66.4 |
| 3E2.1_GS_CL-34565 | PR-1613189 | 76.1 | 65.7 | 93.3 |
| 3E2.1_GS_4G8.5 | PR-1612499 | 98.0 | 46.9 | 95.0 |
| 3E2.1_GS_9E10.1 | PR-1612500 | 126.0 | 59.2 | 85.0 |
| 3E2.1_GS_9E10.6 | PR-1612501 | 141.0 | 61.0 | 86.5 |
| 3E2.1_GS_1B10.1 | PR-1612502 | 141.0 | 61.0 | 97.0 |
| 3E2.1_GS_1E3.4 | PR-1613190 | 107.8 | 79.9 | 96.5 |
| 9E10.1_SL_CL-33675 | PR-1629646 | 7.6 | 1.0 | 98.7 |
| 1B10.1_SL_CL-33675 | PR-1629647 | 157.0 | 111.7 | 63.3 |
| 9E10.1_LS_CL-33675 | PR-1629648 | 64.4 | 36.4 | 92.9 |
| 1B10.1_LS_CL-33675 | PR-1629649 | 218.4 | 157.7 | 65.4 |

Example 13.2: Binding Affinity of Anti-VEGF-A/Anti-PDGF-BB DVD-Ig Molecules and CO-DVD-Ig Molecules The binding affinity of anti-VEGF-A/anti-PDGF-BB DVD-Ig molecules and CO-DVD-Ig molecules to VEGF-A and PDGF-BB were measured by Biacore using the method described in Example 1.1 and the data is summarized in Tables 61 and 62 below.

TABLE 61

Biacore Binding of Anti-VEGF/anti-PDGF DVD-Ig Molecules

| | | VEGF | | | PDGF | | |
|---|---|---|---|---|---|---|---|
| DVD Name | Corporate ID | $k_{on}$ (M−1 s−1) | $k_{off}$ (M−1) | $K_D$ (M) | $k_{on}$ (M−1 s−1) | $k_{off}$ (M−1) | $K_D$ (M) |
| 9E8.4-GS-4G8.3 | PR-1563988 | 2.2E+05 | 6.3E−05 | 2.9E−10 | 1.0E+07 | 2.0E−04 | 2.0E−11 |
| 9E8.4-SS-4G8.3 | PR-1563990 | 1.6E+05 | 1.2E−04 | 7.8E−10 | 1.0E+07 | 2.0E−04 | 2.0E−11 |
| 9E8.4-SL-4G8.3 | PR-1563998 | 7.0E+05 | 8.0E−05 | 1.2E−10 | 1.0E+07 | 1.9E−04 | 1.9E−11 |
| 9E8.4-LS-4G8.3 | PR-1564009 | 2.7E+05 | 5.5E−05 | 2.0E−10 | 1.0E+07 | 2.0E−04 | 2.0E−11 |
| 4G8.3-GS-9E8.4 | PR-1564010 | 3.3E+06 | 5.7E−05 | 1.7E−11 | 1.0E+07 | 1.4E−04 | 1.3E−11 |
| 4G8.3-SS-9E8.4 | PR-1564011 | 3.1E+06 | 4.1E−05 | 1.3E−11 | 7.5E+06 | 1.5E−04 | 1.9E−11 |
| 4G8.3-SL-9E8.4 | PR-1564012 | 3.1E+06 | 4.1E−05 | 1.3E−11 | 1.4E+07 | 1.4E−04 | 9.9E−12 |
| 4G8.3-LS-9E8.4 | PR-1564013 | 3.1E+06 | 3.9E−05 | 1.2E−11 | 1.7E+07 | 1.4E−04 | 8.6E−12 |
| DVD3904 | PR-1565031 | 6.1E+05 | 1.1E−04 | 1.9E−10 | 1.0E+07 | 9.0E−04 | 9.0E−11 |
| DVD3905 | PR-1565032 | 1.1E+06 | 1.0E−04 | 9.4E−11 | 1.0E+07 | 1.8E−03 | 1.8E−10 |
| DVD3906 | PR-1565035 | 9.2E+05 | 9.3E−05 | 1.0E−10 | 1.0E+07 | 7.2E−03 | 7.2E−10 |
| 4G8.3-GS(9)-9E8.4 (g) | PR-1572102 | 6.0E+06 | 7.6E−05 | 1.3E−11 | 1.3E+07 | 1.7E−04 | 1.3E−11 |
| 4G8.3-GS(11)-9E8.4 (g) | PR-1572103 | 6.3E+06 | 7.5E−05 | 1.2E−11 | 1.4E+07 | 1.7E−04 | 1.3E−11 |
| 4G8.3-GS(noR)-9E8.4 (g) | PR-1572104 | 6.1E+06 | 6.9E−05 | 1.1E−11 | 1.5E+07 | 1.4E−04 | 8.9E−12 |
| 4G8.3-SL-9E8.4 (g) | PR-1572105 | 5.6E+06 | 6.1E−05 | 1.1E−11 | 1.3E+07 | 1.7E−04 | 1.3E−11 |
| 4G8.3-LS-9E8.4 (g) | PR-1572106 | 6.3E+06 | 5.1E−05 | 8.1E−12 | 1.8E+07 | 2.0E−04 | 1.1E−11 |
| 4G8.3-GS-9E8.4E | PR-1575832 | 6.1E+06 | 8.0E−05 | 1.3E−11 | 1.3E+07 | 2.7E−04 | 2.0E−11 |
| 4G8.3-SL-9E8.4E | PR-1575834 | 6.2E+06 | 6.3E−05 | 1.0E−11 | 1.7E+07 | 2.5E−04 | 1.5E−11 |
| 4G8.3-LS-9E8.4E | PR-1575835 | 5.8E+06 | 5.9E−05 | 1.0E−11 | 2.0E+07 | 2.8E−04 | 1.4E−11 |
| 9A8.12-GS-9E8.4E | PR-1577165 | 7.7E+05 | 1.4E−04 | 1.8E−10 | 3.3E+07 | 2.6E−04 | 8.1E−12 |
| 9A8.12-SL-9E8.4E | PR-1577166 | 2.5E+05 | 1.2E−04 | 4.7E−10 | 2.7E+07 | 2.3E−04 | 8.3E−12 |
| 9A8.12-LS-9E8.4E | PR-1577547 | 2.7E+05 | 9.3E−05 | 3.5E−10 | 3.6E+07 | 2.3E−04 | 6.5E−12 |
| 9E8.4E-SL-9A8.12 | PR-1577548 | 2.2E+06 | 3.4E−04 | 1.6E−10 | 5.0E+07 | 3.2E−04 | 6.4E−12 |
| 9E8.4E-LS-9A8.12 | PR-1577550 | 6.4E+05 | 1.5E−04 | 2.3E−10 | 5.0E+07 | 2.5E−04 | 5.0E−12 |

TABLE 61-continued

Biacore Binding of Anti-VEGF/anti-PDGF DVD-Ig Molecules

|  |  | VEGF | | | PDGF | | |
| --- | --- | --- | --- | --- | --- | --- | --- |
| DVD Name | Corporate ID | $k_{on}$ (M−1 s−1) | $k_{off}$ (M−1) | $K_D$ (M) | $k_{on}$ (M−1 s−1) | $k_{off}$ (M−1) | $K_D$ (M) |
| 9E8.4E-GS-9A8.12 | PR-1578137 | 4.7E+05 | 1.8E−04 | 3.8E−10 | 5.0E+07 | 4.4E−04 | 8.8E−12 |
| CL-34565_GS_CL-33675 | PR-1613183 | 1.2E+07 | 2.0E−05 | 1.7E−12 | 6.0E+07 | 1.1E−05 | 1.9E−13 |
| CL-34565_GS_9E8.4 | PR-1613184 | 1.5E+07 | 1.6E−05 | 1.1E−12 | 3.5E+07 | 1.9E−04 | 5.4E−12 |
| CL-34565_GS_3E2.1 | PR-1613185 | 1.2E+07 | 1.7E−05 | 1.4E−12 | 4.5E+07 | 5.2E−04 | 1.2E−11 |
| 4G8.5_GS_CL-33675 | PR-1611291 | 4.7E+06 | 3.1E−05 | 6.6E−12 | 1.6E+07 | 1.2E−05 | 7.4E−13 |
| 4G8.5_GS_9E8.4 | PR-1612489 | 5.4E+06 | 4.6E−05 | 8.5E−12 | 5.8E+06 | 1.6E−04 | 2.8E−11 |
| 4G8.5_GS_3E2.1 | PR-1610560 | 4.8E+06 | 4.2E−05 | 8.7E−12 | 4.1E+07 | 5.5E−04 | 1.3E−11 |
| 9E10.1_GS_CL-33675 | PR-1610561 | 9.7E+06 | 1.7E−05 | 1.8E−12 | 2.0E+07 | 9.1E−06 | 4.5E−13 |
| 9E10.1_GS_9E8.4 | PR-1612491 | 1.1E+07 | 2.5E−05 | 2.2E−12 | 6.8E+06 | 1.7E−04 | 2.5E−11 |
| 9E10.1_GS_3E2.1 | PR-1610562 | 9.3E+06 | 2.3E−05 | 2.4E−12 | 4.1E+07 | 8.5E−04 | 2.1E−11 |
| 9E10.6_GS_CL-33675 | PR-1612492 | 1.1E+07 | 2.2E−05 | 2.0E−12 | 2.4E+07 | 2.8E−05 | 1.2E−12 |
| 9E10.6_GS_3E2.1 | PR-1610563 | 8.6E+06 | 2.5E−05 | 3.0E−12 | 5.8E+06 | 2.1E−04 | 3.6E−11 |
| 1B10.1_GS_CL-33675 | PR-1611292 | 2.1E+06 | 1.3E−04 | 6.2E−11 | 2.2E+07 | 1.2E−05 | 5.4E−13 |
| 1E3.4_GS_3E2.1 | PR-1612495 | 5.3E+06 | 5.2E−05 | 9.8E−12 | 4.5E+07 | 5.1E−04 | 1.2E−11 |
| CL-33675_GS_4G8.5 | PR-1612496 | 2.3E+05 | 4.0E−05 | 1.8E−10 | 3.8E+07 | 9.0E−06 | 2.3E−13 |
| 3E2.1_GS_4G8.5 | PR-1612499 | 2.4E+05 | 3.9E−05 | 1.7E−10 | ≥9.0E+07 | 3.4E−04 | ≤3.8E−12 |
| 3E2.1_GS_9E10.1 | PR-1612500 | 6.3E+05 | 1.2E−05 | 1.9E−11 | ≥9.0E+07 | 3.9E−04 | ≤4.3E−12 |
| 3E2.1_GS_9E10.6 | PR-1612501 | 5.7E+05 | 2.3E−05 | 4.1E−11 | ≥9.0E+07 | 4.5E−04 | ≤5.3E−12 |
| 3E2.1_GS_1B10.1 | PR-1612502 | 3.5E+05 | 1.2E−04 | 3.2E−10 | 8.4E+07 | 1.5E−04 | 1.8E−12 |
| 3E2.1_GS_1E3.4 | PR-1613190 | 3.6E+05 | 9.2E−05 | 2.6E−10 | ≥9.0E+07 | 4.8E−04 | ≤5.3E−12 |

TABLE 62

Biacore Binding of Anti-VEGF/anti-PDGF CO-DVD-Ig Molecules

| CO-DVD-Ig Name | Corporate ID | VEGF | | | PDGF | | |
| --- | --- | --- | --- | --- | --- | --- | --- |
|  |  | $k_{on}$ (M−1 s−1) | $k_{off}$ (M−1) | $K_D$ (M) | $k_{on}$ (M−1 s−1) | $k_{off}$ (M−1) | $K_D$ (M) |
| CODV003 | PR-1565044 |  | no binding |  | 2.3E+07 | 2.5E−04 | 1.1E−11 |
| CODV004 | PR-1565051 |  | no binding |  | 1.0E+07 | 8.7E−04 | 8.7E−11 |
| CODV005 | PR-1565083 |  |  | 3.5E−08 | 1.2E+07 | 1.3E−04 | 1.1E−11 |
| CODV006 | PR-1565084 |  | no binding |  | 2.2E+07 | 2.1E−04 | 9.7E−12 |
| CODV007 | PR-1565085 |  |  | 2.2E−08 | 2.9E+07 | 2.2E−04 | 7.3E−12 |
| CODV008 | PR-1565086 |  | no binding |  | 1.7E+07 | 1.3E−04 | 7.4E−12 |
| CODV009 | PR-1571821 |  |  | 2.6E−08 | 3.5E+07 | 2.0E−04 | 5.6E−12 |
| CODV010 | PR-1571823 | 5.7E+04 | 3.7E−04 | 6.6E−09 | 4.1E+07 | 1.6E−04 | 4.0E−12 |
| CODV011 | PR-1575521 | 1.1E+06 | 4.0E−05 | 3.8E−11 | 3.8E+07 | 6.9E−05 | 1.8E−12 |
| CODV012 | PR-1571824 | 2.7E+06 | 7.6E−05 | 2.8E−11 | 7.0E+07 | 1.0E−04 | 1.5E−12 |
| CODV014 | PR-1571826 | 2.2E+06 | 7.7E−05 | 3.6E−11 | 5.5E+07 | 1.3E−04 | 2.4E−12 |
| CODV015 | PR-1571827 | 2.7E+06 | 6.5E−05 | 2.4E−11 | 7.0E+07 | 9.1E−05 | 1.3E−12 |
| CODV016 | PR-1571828 | 2.9E+06 | 5.9E−05 | 2.0E−11 | 4.6E+07 | 1.1E−04 | 2.5E−12 |
| CODV017 | PR-1571830 | — | — | 5.7E−08 | 3.0E+07 | 2.0E−04 | 6.5E−12 |
| CODV018 | PR-1571831 | — | — | 3.1E−08 | 3.5E+07 | 1.9E−04 | 5.3E−12 |
| CODV019 | PR-1571832 | 2.9E+06 | 1.4E−04 | 5.0E−11 | 3.9E+07 | 1.7E−04 | 4.4E−12 |
| CODV020 | PR-1571836 | 3.1E+06 | 1.0E−04 | 3.3E−11 | 4.6E+07 | 1.6E−04 | 3.5E−12 |
| CODV021 | PR-1577053 | 3.8E+06 | 6.8E−05 | 1.8E−11 | 6.1E+07 | 1.2E−04 | 1.9E−12 |
| CODV022 | PR-1577056 | 4.5E+06 | 5.6E−05 | 1.3E−11 | 3.2E+07 | 1.3E−04 | 4.2E−12 |

Example 13.2.1: Binding of Anti-VEGF/anti-PDGF DVD-Ig Molecule (PR-1610561) to Various VEGF-A Isoforms and VEGF-A and PDGF-BB of Different Species Binding of anti-VEGF/anti-PDGF DVD-Ig molecule (PR-1610561) and their parental monoclonal antibodies to various VEGF-A isoforms and VEGF-A and PDGF-BB of different species were measured by Biacore using the method described in Example 1.1 and the data is summarized in Table 63 below. Tables 63A-B summarize the high affinity for VEGF-A$_{165}$ (65 pM), VEGF-A$_{121}$ (230 pM), VEGF-A$_{111}$ (290 pM), isoforms and the high affinity for soluble PDGF-BB (5 pM), observed for PR-1610561. The data shows that PR-1610561 binds to both soluble and extra-cellular-matrix (ECM) bound forms of PDGF-BB.

TABLE 63

Binding of Anti-VEGF/Anti-PDGF DVD-Ig Molecule (PR-1610561) and Parental mAbs to VEGF-A Isoforms and PDGF

| | | | | human VEGF 165 PR-1350437, 1925483 | | | human PDGF-B PR-1373790, 1926007 | | |
|---|---|---|---|---|---|---|---|---|---|
| No | | PR- | lot | $K_a$ ($M^{-1}s^{-1}$) | $K_d$ ($s^{-1}$) | $K_D$ (M) | $K_a$ ($M^{-1}s^{-1}$) | $K_d$ ($s^{-1}$) | $K_D$ (M) |
| 1 | 9E10.1-GS-33675 | PR-1610561 | 2213329 | 5.2E+05 | 3.4E−05 | 6.5E−11 | ≥1.0E+07 | 5.2E−05 | ≤5.2E−12 |
| 2 | AB014 (Avastin) | PR-1545939 | 2129911 | 5.5E+05 | 4.1E−05 | 7.6E−11 | | | |
| 3 | AB642 (9E10.1) | PR-1594047 | 2169800 | 1.6E+07 | 2.8E−05 | 1.8E−12 | | | |
| 4 | CL-33675 | PR-1593725 | 2178826 | | | | ≥1.0E+07 | 5.8E−06 | ≤5.8E−13 |
| | | | | human VEGF 121 PR-1515941, 2069355 | | | | | |
| No | | PR- | lot | $K_a$ ($M^{-1}s^{-1}$) | $K_d$ ($s^{-1}$) | $K_D$ (M) | | | |
| 1 | 9E10.1-GS-33675 | PR-1610561 | 2213329 | 1.8E+05 | 4.1E−05 | 2.3E−10 | | | |
| 2 | AB014 (Avastin) | PR-1545939 | 2129911 | 1.8E+05 | 5.1E−05 | 2.8E−10 | | | |
| 3 | AB642 (9E10.1) | PR-1594047 | 2169800 | 3.2E+06 | 6.8E−05 | 2.1E−11 | | | |
| 4 | CL-33675 | PR-1593725 | 2178826 | | | | | | |
| | | | | human VEGF 111 PR-1520687, 2074657 | | | | | |
| No | | PR- | lot | $K_a$ ($M^{-1}s^{-1}$) | $K_d$ ($s^{-1}$) | $K_D$ (M) | | | |
| 1 | 9E10.1-GS-33675 | PR-1610561 | 2213329 | 1.5E+05 | 4.3E−05 | 2.9E−10 | | | |
| 2 | AB014 (Avastin) | PR-1545939 | 2129911 | 1.4E+05 | 5.3E−05 | 3.8E−10 | | | |
| 3 | AB642 (9E10.1) | PR-1594047 | 2169800 | 1.8E+06 | 1.0E−04 | 5.8E−11 | | | |
| 4 | CL-33675 | PR-1593725 | 2178826 | | | | | | |
| | | | | | | | cyno PDGF-B PR-1575400, 2154322 | | |
| No | | PR- | lot | cyno VEGF has similar sequence as human | | | $K_a$ ($M^{-1}s^{-1}$) | $K_d$ ($s^{-1}$) | $K_D$ (M) |
| 1 | 9E10.1-GS-33675 | PR-1610561 | 2213329 | | | | ≥1.0E+07 | 8.1E−06 | ≤8.1E−13 |
| 2 | AB014 (Avastin) | PR-1545939 | 2129911 | | | | | | |
| 3 | AB642 (9E10.1) | PR-1594047 | 2169800 | | | | | | |
| 4 | CL-33675 | PR-1593725 | 2178826 | | | | ≥1.0E+07 | 1.3E−05 | ≤1.3E−12 |
| | | | | mouse VEGF PR-1578904, 2150241 | | | mouse PDGF-B PR-1577160, 2147923 | | |
| No | | PR- | lot | $K_a$ ($M^{-1}s^{-1}$) | $K_d$ ($s^{-1}$) | $K_D$ (M) | $K_a$ ($M^{-1}s^{-1}$) | $K_d$ ($s^{-1}$) | $K_D$ (M) |
| 1 | 9E10.1-GS-33675 | PR-1610561 | 2213329 | | | potentially very weak binding | ≥1.0E+07 | 5.2E−05 | ≤5.2E−12 |
| 2 | AB014 (Avastin) | PR-1545939 | 2129911 | | | no binding | | | |
| 3 | AB642 (9E10.1) | PR-1594047 | 2169800 | | | potentially very weak binding | | | |
| 4 | CL-33675 | PR-1593725 | 2178826 | | | | ≥1.0E+07 | 5.8E−06 | ≤5.8E−13 |
| | | | | rat VEGF PR-1645045, 2235296 | | | rat PDGF-B PR-1645048, 2235300 | | |
| No | | PR- | lot | $K_a$ ($M^{-1}s^{-1}$) | $K_d$ ($s^{-1}$) | $K_D$ (M) | $K_a$ ($M^{-1}s^{-1}$) | $K_d$ ($s^{-1}$) | $K_D$ (M) |
| 1 | 9E10.1-GS-33675 | PR-1610561 | 2213329 | | | potentially very weak binding | ≥1.0E+07 | 5.2E−05 | ≤5.2E−12 |
| 2 | AB014 (Avastin) | PR-1545939 | 2129911 | | | no binding | | | |
| 3 | AB642 (9E10.1) | PR-1594047 | 2169800 | | | potentially very weak binding | | | |
| 4 | CL-33675 | PR-1593725 | 2178826 | | | | ≥1.0E+07 | 5.8E−06 | ≤5.8E−13 |
| | | | | rabbit VEGF PR-1563693, 2130027 | | | | | |
| No | | PR- | lot | $K_a$ ($M^{-1}s^{-1}$) | $K_d$ ($s^{-1}$) | $K_D$ (M) | rabbit PDGF-B has similar sequence as rat | | |
| 1 | 9E10.1-GS-33675 | PR-1610561 | 2213329 | 9.6E+05 | 4.0E−05 | 4.1E−11 | | | |
| 2 | AB014 (Avastin) | PR-1545939 | 2129911 | 9.4E+05 | 4.4E−05 | 4.7E−11 | | | |

TABLE 63-continued

Binding of Anti-VEGF/Anti-PDGF DVD-Ig Molecule (PR-1610561) and Parental mAbs to VEGF-A Isoforms and PDGF

| | | | | | | |
|---|---|---|---|---|---|---|
| 3 | AB642 (9E10.1) | PR-1594047 | 2169800 | 1.6E+07 | 2.8E−05 | 1.8E−12 |
| 4 | CL-33675 | PR-1593725 | 2178826 | | | |

TABLE 63A

Affinity of PR-1610561 to Various Isoforms of Human VEGF-A

| | Human VEGF-A Isoforms | | |
|---|---|---|---|
| | $A_{165}$ | $A_{121}$ | $A_{111}$ |
| Affinity $K_D$ (pM) | 65 | 230 | 290 |

TABLE 63B

Affinity of PR-1610561 to Human PDGF-BB

| Human PDGF-BB Forms | Soluble | ECM-associated |
|---|---|---|
| Affinity $K_D$ (pM) | 5 | n/t |
| Cell Staining | n/t | + |

Example 13.3: Neutralization Potencies of Anti-VEGF-A/anti-PDGF-BB DVD-Ig Molecules and CO-DVD-Ig Molecules The DVD-Ig molecules and CO-DVD-Ig molecules were evaluated for their potencies to block $VEGF_{165}$/VEGFR2 interaction (Example 1.4) and neutralize $VEGF_{165}$ activity in HMVEC-d or VEGFR2-3T3 proliferation assays (Examples 1.10 and 1.7). The molecules were also characterized for the ability to block PDGF-BB/PDGF-Rβ interaction (Example 1.13) and inhibition of PDGF-BB induced proliferation of NIH-3T3 cells (Example 1.15). The data is summarized in Table 64 below. PR-1610561 exhibited neutralization activity against human VEGF-A ($IC_{50}$ of 145 pM) and human PDGF-BB ($IC_{50}$ of 34 pM), as summarized in Table 64A.

TABLE 64

Human VEGF-A and Human PDGF-BB Neutralization Potency of Anti-VEGF-A/anti-PDGF-BB DVD-Ig and CO-DVD-Ig Proteins

| | | Potency IC50 (nM) | | | | |
|---|---|---|---|---|---|---|
| DVD-Ig | Corporate ID | HMVEC-d $hVEGF_{165}$ | VEGFR2-3T3 $hVEGF_{165}$ | NIH-3T3 hPDGF-BB | hVEGFR2 Competition ELISA $IC_{50}$ nM | hPDGF β Competition ELISA $IC_{50}$ nM |
| 9E8.4-GS-4G8.3 | PR-1563988 | 2.643 | >5 | 0.076 | NT | NT |
| 9E8.4-SS-4G8.3 | PR-1563990 | NT | >5 | 0.094 | NT | NT |
| 9E8.4-SL-4G8.3 | PR-1563998 | NT | >5 | 0.091 | NT | NT |
| 9E8.4-LS-4G8.3 | PR-1564009 | NT | >5 | 0.104 | NT | NT |
| 4G8.3-GS-9E8.4 | PR-1564010 | 0.096 | NT | NT | 0.126 | NT |
| 4G8.3-GS-9E8.4E | PR-1575832 | NT | 2.953 | >5 | NT | NT |
| 4G8.3-SS-9E8.4 | PR-1564011 | NT | 0.747 | 5.511 | NT | NT |
| 4G8.3-SL-9E8.4 | PR-1564012 | NT | NT | 0.365 | 0.086 | NT |
| 4G8.3-SL-9E8.4E | PR-1575834 | NT | 3.090 | 0.572 | NT | NT |
| 4G8.3-LS-9E8.4 | PR-1564013 | 0.060 | NT | 0.152 | 0.092 | NT |
| CODV009 | PR-1571821 | NT | >5 | >5 | NT | NT |
| CODV010 | PR-1571823 | NT | >5 | 2.139 | NT | NT |
| CODV011 | PR-1575521 | NT | 2.553 | 0.043 | NT | NT |
| CODV012 | PR-1571824 | NT | 1.424 | 0.182 | NT | NT |
| CODV013 | PR-1571825 | NT | 0.785 | 0.11 | NT | NT |
| CODV014 | PR-1571826 | NT | 3.768 | 0.469 | NT | NT |
| CODV015 | PR-1571827 | 0.104 | 0.407 | 0.075 | NT | NT |
| CODV021 | PR-1577053 | NT | >5 | 0.056 | NT | NT |
| CODV016 | PR-1571828 | 0.115 | 0.503 | 0.096 | NT | NT |
| CODV022 | PR-1577056 | NT | 1.462 | 0.059 | NT | NT |
| CODV017 | PR-1571830 | NT | >5 | >5 | NT | NT |
| CODV018 | PR-1571831 | NT | >5 | >5 | NT | NT |
| DVD3904 | PR-1565031 | NT | >5 | >5 | NT | NT |
| DVD3905 | PR-1565032 | NT | >5 | >5 | NT | NT |
| DVD3906 | PR-1565035 | NT | >5 | >5 | NT | NT |
| CODV003 | PR-1565044 | NT | >5 | >5 | NT | NT |
| CODV004 | PR-1565051 | NT | >5 | >5 | NT | NT |
| CODV005 | PR-1565083 | NT | >5 | >5 | NT | NT |
| CODV006 | PR-1565084 | NT | >5 | >5 | NT | NT |
| CODV007 | PR-1565085 | NT | >5 | >5 | NT | NT |
| CODV008 | PR-1565086 | NT | >5 | >5 | NT | NT |
| 4G8.3-GS(9)-9E8.4 (g) | PR-1572102 | 0.417 | 0.986 | .528 | 0.157 | >5 |
| 4G8.3-GS(11)-9E8.4 (g) | PR-1572103 | NT | 0.318 | 0.298 | NT | NT |
| 4G8.3-GS(noR)-9E8.4 (g) | PR-1572104 | NT | 0.217 | 0.095 | NT | NT |
| 4G8.3-SL-9E8.4 (g) | PR-1572105 | 0.347 | 1.603 | 0.290 | 0.111 | >5 |
| 4G8.3-LS-9E8.4 (g) | PR-1572106 | NT | 0.203 | 0.109 | NT | NT |

TABLE 64-continued

Human VEGF-A and Human PDGF-BB Neutralization Potency of
Anti-VEGF-A/anti-PDGF-BB DVD-Ig and CO-DVD-Ig Proteins

| | | Potency IC50 (nM) | | | | |
|---|---|---|---|---|---|---|
| DVD-Ig | Corporate ID | HMVEC-d hVEGF$_{165}$ | VEGFR2-3T3 hVEGF$_{165}$ | NIH-3T3 hPDGF-BB | hVEGFR2 Competition ELISA IC$_{50}$ nM | hPDGF β Competition ELISA IC$_{50}$ nM |
| 4G8.3-LS-9E8.4E | PR-1575835 | NT | 2.852 | 0.176 | NT | NT |
| 9A8.12-GS-9E8.4E | PR-1577165 | NT | 2.992 | 0.204 | NT | NT |
| 9A8.12-SL-9E8.4E | PR-1577166 | NT | 5.536 | 0.148 | NT | NT |
| 9A8.12-LS-9E8.4E | PR-1577547 | NT | 4.13 | 0.133 | NT | NT |
| 9E8.4E-SL-9A8.12 | PR-1577548 | NT | >5 | 0.147 | NT | NT |
| 9E8.4E–LS-9A8.12 | PR-1577550 | NT | >5 | 0.066 | NT | NT |
| 9E8.4E-GS-9A8.12 | PR-1578137 | NT | >5 | 0.327 | NT | NT |
| hVEGF 4G8.3-GS-hPDGF 9E8.4 [hu IgG1/k] mut(234, 235) H435A | PR-1569574 | 0.341 | 1.02 | 0.630 | 0.137 | >5 |
| hVEGF 4G8.3-SL-hPDGF 9E8.4 [hu IgG1/k] mut(234, 235) H435A | PR-1569579 | 0.36 | 1.178 | 0.427 | 0.133 | >5 |
| hVEGF 4G8.3-LS-hPDGF 9E8.4 [hu IgG1/k] mut(234, 235) H435A | PR-1575573 | NT | NT | NT | 0.131 | >5 |
| AB014-GS6-9E8.4 VH-VK | PR-1599234 | 0.124 | NT | 0.222 | NT | NT |
| AB014-GS10-9E8.4 VH-VK | PR-1599236 | 0.095 | NT | 0.063 | NT | NT |
| AB014-GS15-9E8.4 VH-VK | PR-1599239 | 0.13 | NT | 0.066 | NT | NT |
| AB014-GS10-9E8.4 VK-VH | PR-1599240 | 0.086 | NT | 0.074 | NT | NT |
| 4G8.2-GS10-9E8.4 | PR-1598261 | 0.221 | NT | >5 | NT | NT |
| 4G8.4-GS10-9E8.4 | PR-1598262 | 0.281 | NT | 1.327 | NT | NT |
| 4G8.5-GS10-9E8.4 | PR-1598263 | 0.079 | NT | >5 | NT | NT |
| 4G8.12-GS10-9E8.4 | PR-1598264 | 0.079 | NT | 0.227 | NT | NT |
| 4G8.13-GS10-9E8.4 | PR-1598265 | 0.907 | NT | 0.255 | NT | NT |
| 4G8.14-GS10-9E8.4 | PR-1598266 | 0.113 | NT | 0.459 | NT | NT |
| 4G8.5__GS__CL-33675 | PR-1611291 | 0.076 | NT | 0.05 | NT | NT |
| 4G8.5__GS__3E2.1 | PR-1610562 | 0.072 | NT | 1.398 | NT | NT |
| 9E10.1__GS__CL-33675 | PR-1610561 | 0.145 | 0.433 | 0.034 | 0.045 | 0.09 |
| 9E10.1__GS__3E2.1 | PR-1610562 | 0.054 | NT | 5.724 | NT | NT |
| 9E10.6__GS__3E2.1 | PR-1610563 | 0.06 | NT | 1.317 | NT | NT |
| 1B10.1__GS__CL-33675 | PR-1611292 | 0.05 | NT | 0.037 | NT | NT |
| 1B10.1__GS__3E2.1 | PR-1610564 | 0.084 | NT | 1.545 | NT | NT |
| 1E3.4__GS__CL-33675 | PR-1611293 | 0.067 | NT | 0.037 | NT | NT |
| 1E3.4__GS__9E8.4 | PR-1611294 | 0.092 | NT | 0.329 | NT | NT |
| CL-33675__GS__9E10.1 | PR-1611295 | 0.064 | NT | 0.031 | NT | NT |
| CL-33675__GS__9E10.6 | PR-1611296 | 0.082 | NT | 0.037 | NT | NT |
| CL-33675__GS__1E3.4 | PR-1611297 | 0.372 | NT | 0.039 | NT | NT |
| 9E8.4__GS__9E10.1 | PR-1611298 | 0.073 | NT | 0.317 | NT | NT |
| 9E8.4__GS__9E10.6 | PR-1611299 | 0.132 | NT | 0.213 | NT | NT |
| 9E8.4__GS__1B10.1 | PR-1611300 | 0.391 | NT | 0.109 | NT | NT |
| 9E8.4__GS__1E3.4 | PR-1611301 | 0.897 | NT | 0.131 | NT | NT |
| 4G8.5__GS__9E8.4 | PR-1612489 | 0.069 | NT | 4.829 | NT | NT |
| 9E10.1__GS__9E8.4 | PR-1612491 | 0.059 | NT | 1.913 | NT | NT |
| 9E10.6__GS__CL-33675 | PR-1612492 | 0.05 | NT | 0.037 | NT | NT |
| 9E10.6__GS__9E8.4 | PR-1612493 | 0.049 | NT | 1.14 | NT | NT |
| 1B10.1__GS__9E8.4 | PR-1612494 | 0.127 | NT | 0.678 | NT | NT |
| 1E3.4__GS__3E2.1 | PR-1612495 | 0.043 | NT | 6.253 | NT | NT |
| CL-33675__GS__4G8.5 | PR-1612496 | 0.219 | NT | 0.035 | NT | NT |
| CL-33675__GS__1B10.1 | PR-1612498 | 0.265 | NT | 0.11 | NT | NT |
| 3E2.1__GS__4G8.5 | PR-1612499 | 0.743 | NT | 0.38 | NT | NT |
| 3E2.1__GS__9E10.1 | PR-1612500 | 0.133 | NT | 0.394 | NT | NT |
| 3E2.1__GS__9E10.6 | PR-1612501 | 0.188 | NT | 0.377 | NT | NT |
| 3E2.1__GS__1B10.1 | PR-1612502 | 1.78 | NT | 0.187 | NT | NT |
| CL-34565__GS__CL-33675 | PR-1613183 | 0.059 | NT | 0.052 | NT | NT |
| CL-34565__GS__9E8.4 | PR-1613184 | 0.065 | NT | 0.323 | NT | NT |
| CL-34565__GS__3E2.1 | PR-1613185 | 0.053 | NT | 6.005 | NT | NT |
| CL-33675__GS__CL-34565 | PR-1613186 | 0.05 | NT | 0.043 | NT | NT |
| 9E8.4__GS__CL-34565 | PR-1613187 | 0.058 | NT | 0.134 | NT | NT |
| 9E8.4__GS__4G8.5 | PR-1613188 | 0.354 | NT | 0.108 | NT | NT |
| 3E2.1__GS__CL-34565 | PR-1613189 | 0.063 | NT | 1.157 | NT | NT |
| 3E2.1__GS__1E3.4 | PR-1613190 | 0.709 | NT | 0.896 | NT | NT |

NT—Not tested

TABLE 64A

Neutralization Activities in Cellular Assays

| Protein | Human VEGF-A | Human PDGF-BB |
|---|---|---|
| Potency $IC_{50}$ (pM) | 145 | 34 |

Selected DVD-Ig molecules were further characterized for the ability to neutralize human $VEGF_{111}$ and human $VEGF_{121}$, isoforms of human VEGF-A. The molecules were tested for inhibition of $VEGF_{111}$ and human $VEGF_{121}$ induced proliferation of VEGFR2-3T3 cells (Example 1.8). Neutralization of non-human VEGF-A species was also evaluated. Molecules were tested for inhibition of rabbit $VEGF_{165}$ induced proliferation of VEGFR2-3T3 cells (Example 1.9). The data is summarized in Table 65 below. As noted, the amino acid sequence of cynomolgus monkey VEGF-A is identical to human VEGF-A. Parental antibodies had previously been examined for mouse $VEGF_{164}$ cross-reactivity in a competition ELISA and no blocking was observed (Example 1.5).

TABLE 65

Neutralization of Different VEGF-A Isoforms by Anti-VEGF-A/Anti-PDGF-BB DVD-Ig Molecules

| | | Potency IC50 (nM) | | |
|---|---|---|---|---|
| DVD-Ig and Controls | Corporate ID | human $VEGF_{111}$ | human $VEGF_{121}$ | rabbit $VEGF_{165}$ |
| 4G8.3-GS(9)-9E8.4 (g) | PR-1572102 | 0.771 | 0.182 | 0.869 |
| 4G8.3-SL-9E8.4 (g) | PR-1572105 | 0.654 | 0.139 | 1.194 |
| 4G8.3-LS-9E8.4 (g) | PR-1572106 | 0.431 | 0.148 | 0.601 |
| 4G8.3-LS-9E8.4E | PR-1575835 | NT | NT | 1.534 |
| hVEGF 4G8.3-GS-hPDGF 9E8.4 [hu IgG1/k] mut(234, 235) H435A | PR-1569574 | 0.674 | 0.124 | 0.841 |
| hVEGF 4G8.3-SL-hPDGF 9E8.4 [hu IgG1/k] mut(234, 235) H435A | PR-1569579 | 0.576 | 0.154 | 1.213 |
| 9E10.1_GS_CL-33675 | PR-1610561 | 0.213 | 0.097 | 0.520 |

NT—Not tested

Selected DVD-Ig molecules were further evaluated for their potencies to neutralize PDGF-BB of different species using the assay described in Examples 1.15-1.18. The data is summarized in Table 66 below. As noted, the amino acid sequence of rabbit PDGF-BB is identical to rat PDGF-BB.

TABLE 66

Neutralization of Different PDGF-BB Species by Anti-VEGF-A/Anti-PDGF-BB DVD-Ig Molecules

| | | Potency IC50 (nM) | | |
|---|---|---|---|---|
| DVD-Ig and Controls | Corporate ID | cynoPDGF-BB | mPDGF-BB | ratPDGF-BB |
| 4G8.3-GS-9E8.4 | PR-1564010 | NT | 0.440 | 1.359 |
| 4G8.3-SL-9E8.4 | PR-1564012 | NT | 0.290 | 0.650 |
| 4G8.3-SL-9E8.4E | PR-1575834 | NT | 0.772 | NT |
| 4G8.3-LS-9E8.4 | PR-1564013 | NT | 0.110 | 0.210 |
| 4G8.3-GS(9)-9E8.4 (g) | PR-1572102 | 0.139 | 0.174 | 2.202 |
| 4G8.3-SL-9E8.4 (g) | PR-1572105 | 0.142 | 0.096 | 1.296 |
| 4G8.3-LS-9E8.4 (g) | PR-1572106 | 0.094 | 0.14 | NT |

TABLE 66-continued

Neutralization of Different PDGF-BB Species by Anti-VEGF-A/Anti-PDGF-BB DVD-Ig Molecules

| | | Potency IC50 (nM) | | |
|---|---|---|---|---|
| DVD-Ig and Controls | Corporate ID | cynoPDGF-BB | mPDGF-BB | ratPDGF-BB |
| hVEGF 4G8.3-GS-hPDGF 9E8.4 [hu IgG1/k] mut(234, 235) H435A | PR-1569574 | 0.139 | 0.134 | 1.514 |
| hVEGF 4G8.3-SL-hPDGF 9E8.4 [hu IgG1/k] mut(234, 235) H435A | PR-1569579 | 0.144 | 0.150 | 0.994 |
| 9E10.1_GS_CL-33675 | PR-1610561 | 0.035 | 0.032 | 0.038 |

NT—Not tested

Selected DVD-Ig molecules were evaluated for their ability to neutralize in the presence of a second ligand. To evaluate hPDGF-BB potency, the DVD-Ig molecules were pre-incubated with an excess of human $VEGF_{165}$ prior to testing in the NIH-3T3 proliferation assay (Example 1.21). To evaluate $hVEGF_{165}$ potency, the DVD-Ig molecules were pre-incubated with an excess of human hPDGF-BB prior to testing in the VEGFR2-3T3 (KDR/Flk-1) phosphorylation assay (Example 1.20). The data is summarized in Table 67 below.

TABLE 67

Simultaneous binding to VEGF and PDGF

| | | Co-incubation Potency IC50 (nM) | |
|---|---|---|---|
| DVD-Ig | Corporate ID | hPDGF-BB | $hVEGF_{165}$ |
| 9E8.4-GS-4G8.3 | PR-1563988 | NT | NT |
| 9E8.4-SS-4G8.3 | PR-1563990 | NT | NT |
| 9E8.4-SL-4G8.3 | PR-1563998 | NT | NT |
| 9E8.4-LS-4G8.3 | PR-1563009 | NT | NT |
| 4G8.3-GS-9E8.4 | PR-1564010 | NT | NT |
| 4G8.3-SS-9E8.4 | PR-1564011 | NT | NT |
| 4G8.3-SL-9E8.4 | PR-1564012 | NT | NT |
| 4G8.3-LS-9E8.4 | PR-1564013 | NT | NT |
| 4G8.3-GS(9)-9E8.4 (g) | PR-1572102 | 0.051 | 0.701 |
| 4G8.3-SL-9E8.4 (g) | PR-1572105 | 0.047 | 0.773 |
| hVEGF 4G8.3-GS-hPDGF 9E8.4 [hu IgG1/k] mut(234, 235) H435A | PR-1569574 | 0.032 | 0.594 |
| hVEGF 4G8.3-SL-hPDGF 9E8.4 [hu IgG1/k] mut(234, 235) H435A | PR-1569579 | 0.038 | 0.789 |
| 9E10.1_GS_CL-33675 | PR-1610561 | 0.04 | 0.464 |

NT—Not tested

Selected DVD-Ig molecules were further evaluated for their ability to bind naturally derived human $VEGF_{165}$ (Example 1.11) and naturally derived human PDGF-BB (Example 1.19). The data is summarized in Table 68 below.

TABLE 68

Binding of Anti-VEGF-A/Anti-PDGF-BB DVD-Ig Molecules to hVEGF$_{165}$ and hPDGF-BB by ELISA

| | | Binding | |
|---|---|---|---|
| DVD-Ig | Corporate ID | Platelet derived hPDGF-BB | Y-79 derived hVEGF$_{165}$ |
| 4G8.3-GS(9)-9E8.4 (g) | PR-1572102 | Yes | NT |
| 4G8.3-SL-9E8.4 (g) | PR-1572105 | Yes | NT |
| hVEGF 4G8.3-GS-hPDGF 9E8.4 [hu IgG1/k] mut(234, 235) H435A | PR-1569574 | Yes | NT |
| hVEGF 4G8.3-SL-hPDGF 9E8.4 [hu IgG1/k] mut(234, 235) H435A | PR-1569579 | Yes | NT |
| 9E10.1_GS_CL-33675 | PR-1610561 | Yes | Yes |

NT—Not tested

Example 13.4: Species Cross-Reactivity of an Anti-VEGF/Anti-PDGF DVD-Ig Molecule (PR-1610561)

PR-1610561 was further evaluated for its ability to cross-react with cynomolgus monkey, mouse, rat, and rabbit using cell-based proliferation assays (Examples 1.6, 1.17, 1.18, and 1.25). The data is summarized in Table 69 below.

TABLE 69

Species Cross-Reactivity of Anti-VEGF/anti-PDGF DVD-Ig Molecule (PR-1610561)

| | VEGF | | | | PDGF | | | |
|---|---|---|---|---|---|---|---|---|
| Protein | cyno | mo | rat | rab | cyno | mo | rat | rab |
| Affinity K$_D$ (pM) | 65 | — | — | 41 | 0.8 | 0.3 | 3 | 3 |

Example 13.5: Reactivity of Anti-PDGF-BB Antibodies and Anti-VEGF-A/Anti-PDGF-BB DVD-Ig Molecules to ECM-Associated PDGF-BB As described in Example 1.27, first recombinant cell line HEK293 cells over-expressing PDGFBB-RM and then HUVEC naturally expressing ECM-associated PDGF-BB cells were used for staining:

HEK293 Cell Staining:

PDGFB-RM transient transfected HEK 293 cells and parental HEK293 cells were re-suspended at 1E6 cells/mL in PBS and fixed in 4% paraformaldehyde at RT for 10 minutes, washed with PBS and 2E5 cells/tube were incubated in blocking buffer (10% goat serum in PBS) for one hour on ice. Cells were washed with PBS and incubated with primary antibody or DVD at 33 nM in antibody dilution buffer (5% goat serum in PBS) for one hour on ice. Cells were washed three times with PBS and incubated with Alexa Fluo 488 conjugated Goat anti-Human IgG (Jackson Immune, code: 109-546-098; lot: 108427) 1:400 dilution in antibody dilution buffer, incubate on ice for 45 minutes. Cells were washed three times with PBS and cytospin onto glass slides and mounted with mounting media with DAPI. Pictures were taken by fluorescent microscopy. Anti-PDGF-BB parental and affinity matured mAbs and three DVD-Ig molecules all showed positive staining on PDGFB-RM transient transfected 293 cells (FIG. 2A) and no staining on parental HEK 293 cells except for the slightly positive staining of affinity matured anti-PDGF-BB mAb. It is unclear if parental HEK 293 cells express low level of PDGF-BB endogenously HUVEC Staining:

HUVEC cells secrete PDGF-BB, and low level of PDGF-BB may be captured on the cell surface as ECM-associated PDGF-BB. Affinity matured anti-PDGF-BB mAb and anti-VEGF/anti-PDGF DVD-Ig built with affinity-matured anti-PDGF-BB mAb was further assessed for its staining on naturally derived ECM-associated PDGF-BB on HUVEC cells. HUVECs (Lonza, cat#: C2519A lot: 181607) were trypsinized, resuspended at 2E4 cells/mL in culture media (Lonza, EGM2 MV Bulletkit: CC-3202). Cells were plated at 10,000 cells/500 µl/well in 8-chamber glass slide and incubated for 16 hours at 37° C., 5% CO$_2$. After incubation, cells were fixed with 200 µl 4% paraformaldehyde at RT for 10 minutes, washed with PBS and incubated in blocking buffer (10% goat serum in PBS) for one hour on ice. Cells were washed with PBS 3× and incubated with primary antibodies or DVD-Ig molecules at 33 nM in antibody dilution buffer (5% goat serum in PBS) for one hour on ice. Cells were washed three times with PBS and incubated with Alexa Fluo 488 conjugated Goat anti-Human IgG (Jackson-Immune, code: 109-546-098; lot: 108427) 1:400 dilution in antibody dilution buffer, incubate on ice for 45 minutes. Cells were washed three times with PBS and mounted with mounting media with DAPI. Pictures were taken by fluorescent microscopy. As shown in FIG. 2B, affinity matured anti-PDGF-BB mAb showed positive staining on HUVEC cells while the staining of parental anti-PDGF-BB mAb on HUVEC cells is not evident (FIG. 2B). Anti-VEGF/anti-PDGF DVD-Ig (PR-1610561) built with affinity-matured anti-PDGF-BB mAb showed positive staining on HUVEC cells but control anti-tetanus toxoid DVD-Ig molecule also showed some weak staining which may be due to the background issue.

Example 13.6: Inhibition of Sprouting in HUVEC/MSC Co-culture Sprouting Assay by Anti-VEGF-A/Anti-PDGF-BB DVD-Ig Molecules As described in Example 1.28, in early therapeutic treatment mode, Cytodex-3 beads (Sigma-Aldrich, cat# C3275) were coated with HUVEC cells (Lonza) overnight, and then embedded (100 beads/well) with human mesenchymal stem cells (Lonza, 20,000 cells/well) in fibrin gel in 24-well tissue culture plates. A 1:1 mixture of fresh EGM-2 complete media (Lonza) and fibroblast (Lonza) conditioned EGM-2 media were added on top of the fibrin gel along with 2 ng/mL of recombinant human HGF. Medium was replaced every 2-3 days till the end of the experiment. After EC sprouts and pericyte coverings were formed, usually on day 4, anti-VEGF-A (4G8.4), anti-PDGFBB (9E8.) or anti-PDGFBB/VEGF-A DVD-Ig were added to the culture medium at 10 nM. 10 days later cells were fixed in 4% PFA overnight at 4° C. Endothelial cells were stained with anti-PECAM (Abcam, ab32457), followed by fluorescence-conjugated secondary antibody, and pericytes were labeled with anti-aSMA-Cy3 (Sigma, C6198). Cells were then viewed by an inverted fluorescence microscope and 5× images were captured (FIG. 3). As seen in the pictures, DVD-Ig molecules as well as the combination of anti-VEGF and anti-PDGF mAbs are able to prevent sprouting formation greater than that of anti-VEGF mAb alone. Neither anti-PDGF mAb or anti-PDGF aptamer alone appear to have any significant inhibition of sprouting formation (FIG. 3). Similar experiments were also conducted in prophylactic and later therapeutic treatment modes and the results clearly demonstrated that anti-VEGF/anti-PDGF DVD-Ig (PR-1610561) strongly inhibited sprouting formation in this 3D co-culture assay.

Example 13.7: Characterization of FcRn and FcγRs Binding

Anti-VEGF/anti-PDGF DVD-Ig molecules, including 4G8.3-GS-9E8.4, 4G8.3-SL-9E8.4, 4G8.3-GS-9E8.4(g), 4G8.3-SL-9E8.4(g), 9E10.1GS_CL-33675, are human IgG1/κ isotype with L234A, L235A mutations to attenuate FcγRs binding and H435A mutation to eliminate FcRn binding. The binding of DVD-Ig molecules to FcRn from various species and the binding of DVD-Ig molecules to various FcγRs were characterized by Biacore using the method described in Example 1.2. The data is summarized in Tables 70 and 71 below.

Example 14: Physicochemical Properties of Anti-VEGF-A/Anti-PDGF-BB DVD-Ig Molecules Example 14.1: Assessment of Physicochemical Properties of Anti-VEGF-A/Anti-PDGF-BB DVD-Ig Molecules Twenty one DVD-Ig molecules were selected for a screen of their solubility and stability profiles. Samples were prepped and evaluated according to Example 2.4. The DVD-Ig proteins were prepared in a formulation buffer and stored at 40° C. and 5° C. for up to 21 days. Samples were pulled and analyzed by SEC to determine changes in aggregation (Table 72). The molecules were evaluated at the listed concentrations. SEC was used to quantitate the aggregation percentage.

TABLE 70

Binding of Anti-VEGF-A/Anti-PDGF-BB DVD-Ig Molecules to FcRn from Different Species, Measured by Biacore

| Immobilized | Steady State | | | 1:1 Binding fit | | | | | |
| --- | --- | --- | --- | --- | --- | --- | --- | --- | --- |
| | huFcRn | cynoFcRn | rabbitFcRn | ratFcRn | | | muFcRn | | |
| | $K_D$ (M) | $K_D$ (M) | $K_D$ (M) | ka (1/Ms) | kd (1/s) | $K_D$ (M) | ka (1/Ms) | kd (1/s) | $K_D$ (M) |
| 4G8.3-GS-9E8.4(g) PR-1572102 | NSB | NSB | NSB | n/a | n/a | NSB | n/a | n/a | NSB |
| 4G8.3-SL-9E8.4(g) PR-1572105 | NSB | NSB | NSB | n/a | n/a | NSB | n/a | n/a | NSB |
| 9E10.1_GS_CL-33675 PR-1610561 | NSB | NSB | NSB | n/a | n/a | NSB | n/a | n/a | NSB |
| 4G8.3-GS-9E8.4 PR-1569574 | NSB | NSB | NSB | n/a | n/a | NSB | n/a | n/a | NSB |
| 4G8.3-SL-9E8.4 PR-1569579 | NSB | NSB | NSB | n/a | n/a | NSB | n/a | n/a | NSB |

* NSB = No significant binding at the concentration tested;
n/a = not available

TABLE 71

Binding of Anti-VEGF-A/Anti-PDGF-BB DVD-Ig Molecules to Various Human FcγRs, Measured by Biacore

| Sample | huFcRIIb $K_D$ (M) | huFcRIIa 131H $K_D$ (M) | huFcRIIa 131R $K_D$ (M) | huFcRIIIa 158F $K_D$ (M) | huFcRIIIa 158V | | | |
| --- | --- | --- | --- | --- | --- | --- | --- | --- |
| | | | | | ka (1/Ms) | kd (1/s) | $K_D$ (M) | Fit |
| 4G8.3-GS-9E8.4(g) PR-1572102 | NSB | NSB | NSB | NSB | n/a | n/a | 7.40E−06 | steady state |
| 4G8.3-SL-9E8.4(g) PR-1572105 | NSB | NSB | NSB | NSB | n/a | n/a | 6.20E−06 | steady state |
| 9E10.1_GS_CL-33675 PR-1610561 | NSB | NSB | NSB | NSB | n/a | n/a | 1.1E−05* | steady state |
| 4G8.3-GS-9E8.4 PR-1569574 | NSB | NSB | NSB | NSB | n/a | n/a | 1.6E−05* | steady state |
| 4G8.3-SL-9E8.4 PR-1569579 | NSB | NSB | NSB | NSB | n/a | n/a | 1.2E−05* | steady state |

*NSB = No significant binding at the concentration tested;
n/a = not available

TABLE 72

Aggregation and Solubility Screening Of Selected DVD-Ig Molecules Stored At 40° C. and 5° C. for 21 Days in a Formulation Buffer

| DVD-Ig Molecule | Concentration (mg/ml) | % Aggregation Change from T0 T21 d 5° C. | T21 d 40° C. |
|---|---|---|---|
| 4G8.3-GS-9E8.4 | 100 | 0.24 | * |
| 4G8.3-SL-9E8.4 | 100 | 0.27 | * |
| CL-34565_GS_CL-33675 | 48.7 | 0.20 | 0.25 |
| CL-34565_GS_9E8.4 | 4.3 | −0.30 | 0.05 |
| CL-34565_GS_3E2.1 | 10.9 | −1.12 | −0.89 |
| 4G8.5_GS_CL-33675 | 50 | −0.09 | * |
| 4G8.5_GS_9E8.4 | 50 | −0.09 | 12.50 |
| 4G8.5_GS_3E2.1 | 50 | 0.53 | 14.63 |
| 9E10.1_GS_CL-33675 | 50 | −2.08 | −3.09 |
| 9E10.1_GS_9E8.4 | 50.7 | 2.95 | −0.39 |
| 9E10.1_GS_3E2.1 | 43.2 | −6.16 | −9.05 |
| 9E10.6_GS_CL-33675 | 50 | 3.17 | 1.87 |
| 9E10.6_GS_3E2.1 | 34.9 | −0.63 | −0.65 |
| 1B10.1_GS_CL-33675 | 50 | 0.72 | 1.10 |
| 1E3.4_GS_3E2.1 | 50 | 0.17 | * |
| CL-33675_GS_4G8.5 | 38.7 | 0.15 | 2.34 |
| 3E2.1_GS_4G8.5 | 50 | 16.15 | * |
| 3E2.1_GS_9E10.1 | 30.4 | * | * |
| 3E2.1_GS_9E10.6 | 50 | 0.17 | 5.55 |
| 3E2.1_GS_1B10.1 | 38.6 | −6.33 | * |
| 3E2.1_GS_1E3.4 | 50 | 10.12 | * |

* Samples were too degraded or compromised to evaluate with SEC (e.g. gelled, precipitated).

Example 14.2: Further Assessment of Physicochemical Properties of Anti-VEGF-A/Anti-PDGF-BB DVD-Ig Molecules (Stability During Storage at 40° C., 25° C., and 5° C.)

Based on the physicochemical screen discussed above (Example 14.1), three anti-VEGF-A/anti-PDGF-BB DVD-Ig molecules (4G8.3-GS-9E8.4, 4G8.3-SL-9E8.4, and 9E10.1-GS-33675) were selected for further characterization. Sample prep and analysis was performed according to Example 2.4.

Briefly, the molecules were prepared in a formulation buffer at 100±10 mg/ml and stored at 40° C., 25° C., and 5° C. for 84 days. Samples were periodically pulled for characterization (Tables 73-75 below).

As mentioned in Example 2.4, both 25° C. (room temperature) and 5° C. (storage temperature) are typical temperatures at which the samples would be subjected either during preparation and storage for manufacture or as part of the final drug product presentation. Also, storage at 40° C. is considered an accelerated stability condition which provides an indication of long-term stability prospects.

TABLE 73

Stability of 4G8.3-GS-9E8.4 During Storage. Aggregate, Monomer, And Fragment Percentages Were Quantitated By SEC

| | % Aggregate | % Monomer | % Fragment | Area Under SEC Chromatogram Signal Relative to T0 |
|---|---|---|---|---|
| T0 | 1.8 | 97.3 | 0.9 | 1.00 |
| T7 d 40° C. | * | * | * | * |
| T7 d 25° C. | 2.2 | 97.0 | 0.9 | 0.91 |
| T7 d 5° C. | 1.9 | 97.2 | 0.9 | 0.92 |
| T21 d 40° C. | * | * | * | * |
| T21 d 25° C. | 3.0 | 96.4 | 0.6 | 0.84 |
| T21 d 5° C. | 1.8 | 97.8 | 0.5 | 0.90 |
| T42 d 40° C. | * | * | * | * |
| T42 d 25° C. | 3.4 | 95.6 | 1.0 | 0.88 |
| T42 d 5° C. | 2.0 | 97.3 | 0.7 | 1.00 |
| T63 d 40° C. | * | * | * | * |
| T63 d 25° C. | 4.2 | 94.7 | 1.0 | 0.85 |
| T63 d 5° C. | 2.1 | 97.4 | 0.5 | 0.92 |
| T84 d 40° C. | * | * | * | * |
| T84 d 25° C. | 5.0 | 93.7 | 1.3 | 0.79 |
| T84 d 5° C. | 2.2 | 97.3 | 0.6 | 0.85 |

* Samples were too degraded or compromised to evaluate with SEC (e.g. gelled, precipitated).

TABLE 74

Stability of 4G8.3-SL-9E8.4 During Storage. Aggregate, Monomer, And Fragment Percentages Were Quantitated by SEC

| | % Aggregate | % Monomer | % Fragment | Area Under SEC Chromatogram Signal Relative to T0 |
|---|---|---|---|---|
| T0 | 4.2 | 94.7 | 1.1 | 1.00 |
| T7 d 40° C. | * | * | * | * |
| T7 d 25° C. | 6.6 | 92.2 | 1.3 | 0.86 |
| T7 d 5° C. | 4.3 | 94.7 | 1.0 | 0.82 |
| T21 d 40° C. | * | * | * | * |
| T21 d 25° C. | 8.5 | 90.5 | 1.1 | 0.77 |
| T21 d 5° C. | 3.9 | 95.3 | 0.8 | 0.87 |
| T42 d 40° C. | * | * | * | * |
| T42 d 25° C. | 13.2 | 85.6 | 1.3 | 0.80 |
| T42 d 5° C. | 4.5 | 94.4 | 1.1 | 0.97 |
| T63 d 40° C. | * | * | * | * |
| T63 d 25° C. | 13.2 | 85.3 | 1.5 | 0.73 |
| T63 d 5° C. | 4.3 | 95.0 | 0.7 | 0.87 |
| T84 d 40° C. | * | * | * | * |
| T84 d 25° C. | 10.3 | 88.1 | 1.6 | 0.62 |
| T84 d 5° C. | 4.5 | 94.7 | 0.7 | 0.80 |

* Samples were too degraded or compromised to evaluate with SEC (e.g. gelled, precipitated).

TABLE 75

Stability of 9E10.1-GS-33675 During Storage. Aggregate, Monomer, And Fragment Percentages Were Quantitated by SEC.

| | % Aggregate | % Monomer | % Fragment | Area Under SEC Chromatogram Signal Relative to T0 |
|---|---|---|---|---|
| T0 | 0.8 | 98.4 | 0.7 | 1.00 |
| T7 d 40° C. | 5.3 | 93.8 | 0.8 | 0.84 |
| T7 d 25° C. | 4.8 | 94.6 | 0.6 | 0.89 |
| T7 d 5° C. | 3.7 | 95.5 | 0.8 | 0.92 |
| T21 d 40° C. | 6.1 | 92.5 | 1.4 | 0.77 |
| T21 d 25° C. | 4.4 | 95.0 | 0.6 | 0.82 |
| T21 d 5° C. | 6.7 | 92.8 | 0.5 | 0.89 |
| T42 d 40° C. | 13.8 | 83.9 | 2.3 | 0.76 |
| T42 d 25° C. | 4.7 | 94.6 | 0.8 | 0.85 |
| T42 d 5° C. | 7.7 | 91.7 | 0.5 | 0.92 |
| T63 d 40° C. | 19.8 | 77.0 | 3.2 | 0.77 |
| T63 d 25° C. | 4.8 | 94.4 | 0.8 | 0.84 |
| T63 d 5° C. | 8.4 | 91.2 | 0.4 | 0.94 |
| T84 d 40° C. | 22.8 | 73.2 | 4.0 | 0.68 |
| T84 d 25° C. | 5.3 | 93.7 | 1.0 | 0.80 |
| T84 d 5° C. | 8.1 | 91.5 | 0.4 | 0.88 |

Both 4G8.3-GS-9E8.4 and 4G8.3-SL-9E8.4 formed a white precipitate when stored at 40° C. after 7 days and thus could not be analyzed by SEC. The samples are assumed to be completely aggregated. At 25° C., there was an observable increase in aggregation for both molecules. The aggregation was less rapid for 4G8.3-GS-9E8.4 than for 4G8.3-SL-9E8.4. Aggregation of the former increased from 1.8% to 5.0% after 84 days while that of the latter started at 4.2% and reached as high as 13.2% over the course of 84 days. At 5° C., there is no noticeable aggregate increase for the two molecules.

For 9E10.1-GS-33675, aggregation at 5° C. increased from 0.8% to 6.7% by 21 days and levelled off at ~8% from 42 to 84 days. At 25° C., aggregation increased from 0.8% to 4.7% by 7 days and levelled off at that value up to 84 days. Finally, aggregation at 40° C. increased from 0.8% to 22.8% in an apparently linear fashion over the course of 84 days. The aggregation at 40° C. for 9E10.1-GS-33675 is much less that that observed for the other two DVD-Ig molecules. This may be the result of the universal formulation buffer used.

There was no apparent change in fragmentation for all three DVD-Ig molecules at 25° C. or 5° C. At 40° C., an apparent and expected increase in fragmentation was observed for 9E10.1-GS-33675 after 21 days.

Example 14.3: Further Assessment of Physicochemical Properties of Anti-VEGF-A/Anti-PDGF-BB DVD-Ig Molecules (Stability to Freeze-Thaw Stress)

Based on the earlier physicochemical screen (Example 14.1), three anti-VEGF-A/anti-PDGF-BB DVD-Ig molecules (4G8.3-GS-9E8.4, 4G8.3-SL-9E8.4, and 9E10.1-GS-33675) were selected for further characterization. Sample prep, stress, and analysis were performed according to Example 2.5. Briefly, the molecules were prepared in a formulation buffer at concentrations of 100±10 mg/ml or 1 mg/ml and subjected to four cycles of freezing (~−80° C.) and thawing (30° C.). Samples were characterized after the second and fourth thaw (Tables 76-81 below).

As mentioned in Example 2.5, protein samples are typically frozen at −80° C. for long term storage as well as shipping to remote manufacturing sites. The samples are then thawed in order to complete the drug product manufacturing process.

TABLE 76

Stability of 4G8.3-GS-9E8.4 at 100 ± 10 mg/ml When Subjected To Freeze-Thaw Stress (−80° C./30° C.). Aggregate, Monomer, And Fragment Percentages Were Quantitated by SEC.

|  | % Aggregate | % Monomer | % Fragment | Area Under SEC Chromatogram Signal Relative to T0 |
| --- | --- | --- | --- | --- |
| F/T 0 | 1.8 | 97.3 | 0.9 | 1.00 |
| F/T 2 | 1.8 | 97.4 | 0.8 | 0.90 |
| F/T 4 | 2.2 | 96.9 | 0.9 | 0.92 |

TABLE 77

Stability of 4G8.3-SL-9E8.4 at 100 ± 10 mg/ml When Subjected To Freeze-Thaw stress (−80° C./30° C.). Aggregate, Monomer, And Fragment Percentages Were Quantitated by SEC

|  | % Aggregate | % Monomer | % Fragment | Area Under SEC Chromatogram Signal Relative to T0 |
| --- | --- | --- | --- | --- |
| F/T 0 | 4.2 | 94.7 | 1.1 | 1.00 |
| F/T 2 | 4.1 | 95.2 | 0.7 | 0.83 |
| F/T 4 | 4.3 | 94.4 | 1.3 | 0.82 |

TABLE 78

Stability of 9E10.1-GS-33675 at 100 ± 10 mg/ml when Subjected To Freeze-Thaw Stress (−80° C./30° C.). Aggregate, Monomer, And Fragment Percentages Were Quantitated by SEC.

|  | % Aggregate | % Monomer | % Fragment | Area Under SEC Chromatogram Signal Relative to T0 |
| --- | --- | --- | --- | --- |
| F/T 0 | 0.8 | 98.4 | 0.7 | 1.00 |
| F/T 2 | 1.1 | 98.5 | 0.4 | 0.91 |
| F/T 4 | 1.8 | 97.6 | 0.6 | 0.88 |

TABLE 79

Stability of 4G8.3-GS-9E8.4 at 1 mg/ml When Subjected To Freeze-Thaw Stress (−80° C./30° C.). Aggregate, Monomer, And Fragment Percentages Were Quantitated by SEC.

|  | % Aggregate | % Monomer | % Fragment | Area Under SEC Chromatogram Signal Relative to T0 |
| --- | --- | --- | --- | --- |
| F/T 0 | 1.8 | 97.3 | 0.9 | 1.00 |
| F/T 2 | 1.9 | 97.5 | 0.6 | 0.95 |
| F/T 4 | 2.0 | 97.1 | 0.9 | 0.96 |

TABLE 80

Stability of 4G8.3-SL-9E8.4 at 1 mg/When Subjected To Freeze-Thaw Stress (−80° C./30° C.). Aggregate, Monomer, And Fragment Percentages Were Quantitated by SEC.

|  | % Aggregate | % Monomer | % Fragment | Area Under SEC Chromatogram Signal Relative to T0 |
| --- | --- | --- | --- | --- |
| F/T 0 | 4.2 | 94.7 | 1.1 | 1.00 |
| F/T 2 | 3.9 | 95.4 | 0.7 | 0.94 |
| F/T 4 | 4.1 | 94.9 | 1.0 | 0.94 |

TABLE 81

Stability of 9E10.1-GS-33675 at 1 mg/ml When Subjected To Freeze-Thaw Stress (−80° C./30° C.). Aggregate, Monomer, And Fragment Percentages Were Quantitated by SEC.

|  | % Aggregate | % Monomer | % Fragment | Area Under SEC Chromatogram Signal Relative to T0 |
| --- | --- | --- | --- | --- |
| F/T 0 | 0.8 | 98.4 | 0.7 | 1.00 |
| F/T 2 | 1.0 | 98.6 | 0.5 | 0.98 |
| F/T 4 | 1.2 | 98.2 | 0.6 | 0.98 |

For all three DVD-Igs, at either 100±10 mg/ml or 1 mg/ml, no apparent increase in aggregation was observed due to freeze-thaw stress after two cycles.

Example 14.4: Further Assessment of Physicochemical Properties of Anti-VEGF-A/Anti-PDGF-BB DVD-Ig Molecules (Viscosity Determination)

Based on the earlier physicochemical screen (Example 14.1), three anti-VEGF-A/anti-PDGF-BB DVD-Ig molecules (4G8.3-GS-9E8.4, 4G8.3-SL-9E8.4, and 9E10.1-GS-33675) were selected for further characterization. The molecules were prepared in a formulation buffer at 100±10 mg/ml and the viscosities were measured at room temperature (Example 2.6). The viscosities were 5.1, 7.2, and 7.2 centipoise, respectively. The values are within the range that enables ease of administration via a small diameter needle attached to a syringe.

Example 14.5: Further Assessment of Physicochemical Properties of Anti-VEGF-A/Anti-PDGF-BB DVD-Ig Molecules (Thermal Stability Assessment)

Based on the earlier physicochemical screen (Example 14.1), three anti-VEGF-A/anti-PDGF-BB DVD-Ig molecules (4G8.3-GS-9E8.4, 4G8.3-SL-9E8.4, and 9E10.1-GS-33675) were selected for further characterization. The molecules were prepared in a formulation buffer at 1 mg/ml according to Example 2.3 and the thermal stabilities were determined according to Example 2.2. The midpoint temperatures of the first transition of unfolding are 52° C., 51° C., and 62° C., respectively. The temperatures at which the first transitions began to appear are 44° C., 42° C., and 62° C., respectively. The data indicate that 9E10.1-GS-33675 has a significantly greater thermal stability than the other two DVD-Ig molecules.

Example 14.6: Physicochemical Properties of an Anti-VEGF/anti-PDGF DVD-Ig Molecule (PR-1610561)

Testing of PR-1610561 revealed high thermostability ($T_{onset}$=62° C.), solubility at least at 76 mg/ml, and a viscosity at 100 mg/ml at room temperature of 7.2 centipoise, which is within the range that enables ease of administration via a small diameter needle attached to a syringe. PR-1610561 has appropriate storage stability in a universal buffer and freeze-thaw stability.

Example 14.76: Intact and Reduced Molecular Weight Determination

Q-TOF LC-MS can detect mass differences between proteins that can result from mis-sense mutations, post-translational modifications, truncations, and other covalent changes that affect protein molecular weight. Table 82 shows the intact molecular weight and deglycosylated intact molecular weight of all three DVD-Ig molecules. Table 83 shows the molecular weights of light chain, heavy chain and deglycosylated heavy chain. The observed molecular weights of the three DVD-Ig molecules match well with the theoretical values with difference of less than 3 Dalton, which is well within the expected range of the error for the instrument.

TABLE 82

Intact molecular weight

| | Intact MW | | Deglycosylated Intact MW | |
|---|---|---|---|---|
| | Theoretical | Observed | Theoretical | Observed |
| PR-1572102 | 203220 | 203219 | 200330 | 200330 |
| PR-1572105 | 204350 | 204348 | 201460 | 201460 |
| PR-1610561 | 202452 | 202450 | 199562 | 199562 |

TABLE 83

Reduced molecular weight

| | Light Chain MW | | Heavy Chain MW | | Deglycosylated HC MW | |
|---|---|---|---|---|---|---|
| | Theoretical | Observed | Theoretical | Observed | Theoretical | Observed |
| PR-1572102 | 36080 | 36080 | 65533 | 65533 | 64088 | 64091 |
| PR-1572105 | 36735 | 36734 | 65444 | 65444 | 63999 | 64002 |
| PR-1610561 | 36006 | 36005 | 65224 | 65224 | 63779 | 63780 |

Example 14.8: Oligosaccharide Profiles by Fc Molecular Weight

DVD-Ig molecules contain N-linked oligosaccharides in the Fc region of the heavy chain Fc molecular weight measurement can provide a semi-quantitative analysis of the oligosaccharide profiles. Table 84 shows the results of oligosaccharide profiles by Fc molecular weight. The oligosaccharide profiles of all three DVD-Ig molecules were similar to what is normally observed for mAbs, with 70-73% Gal 0F and 21-24% Gal 1F. The level of high mannose species was very low in all three samples. No significant level of aglycosylated species was detected.

TABLE 84

Oligosaccharide Profiles By Fc Molecular Weight

| Species | PR-1572102 | PR-1572105 | PR-1610561 |
|---|---|---|---|
| Man 5 | 1.0 | 1.1 | 0.4 |
| Gal 0F-GlcNAc | 0.5 | 0.4 | 0.0 |
| Gal 0 | 0.5 | 0.2 | 0.7 |
| Gal 0F | 73.4 | 73.4 | 70.8 |
| Lys-1 | 0.8 | 0.3 | 0.8 |
| Gal 1F | 21.0 | 21.2 | 23.8 |
| Gal 2F | 2.8 | 3.3 | 3.6 |

Example 14.9: Charge Heterogeneity by Weak Cation Exchange Chromatography and Imaged Isoelectric Focusing Weak cation exchange (WCX) chromatography separates molecules on the basis of the differences in their net surface charge. Variation in the extent of C terminal processing and certain post-translational modifications can lead to different species of an antibody with different charge distributions. Molecules that vary in their charge properties will exhibit different degrees of interaction with ion exchange resins, thus different elution profiles. Each chromatogram is characterized by a predominant peak ("main") and species eluting before ("acidic") or after ("basic"). The relative abundances of these species types are shown in Table 85.

TABLE 85

Results of Weak Cation Exchange Chromatography Analysis

| | Acidic (%) | Main (%) | Basic (%) |
|---|---|---|---|
| PR-1572102 | 9.2 | 63.9 | 26.9 |
| PR-1572105 | 14.9 | 52.4 | 32.7 |
| PR-1610561 | 17.7 | 56.5 | 25.8 |

Imaged capillary isoelectric focusing (icIEF) is a technique that separates proteins on the basis of their isoelectric points or pI values. Different proteins have different pI and peak profiles, which makes icIEF an ideal identity assay. In icIEF, proteins with different pI values focus into distinctive bands in a linear pH gradient formed by ampholytes after applying high voltage. Table 86 shows the theoretical pI (calculated based on amino acid sequence) and the observed pI values measured by imaged icIEF. Also shown in Table 86 are the relative abundances of different charge species detected by imaged icIEF.

TABLE 86

Results of Imaged Isoelectric Focusing

| | Thoe. pI | pI by icIEF | Acidic (%) | Main (%) | Basic (%) |
|---|---|---|---|---|---|
| PR-1572102 | 6.13 | 6.78 | 14.3 | 71.6 | 14.1 |
| PR-1572105 | 6.13 | 6.74 | 25.3 | 60.2 | 14.4 |
| PR-1610561 | 6.67 | 7.27 | 27.2 | 63.2 | 9.6 |

Example 15: Pharmacokinetic Properties of Anti-VEGF-A/Anti-PDGF-BB DVD-Ig Molecules

Example 15.1: Pharmacokinetic Properties of Anti-VEGF-A/Anti-PDGF-BB DVD-Ig Molecules Intravenously Administered in huFcRN Transgenic Mice Studies were conducted in accordance with the AbbVie IACUC guidelines. Anti-VEGF/anti-PDGF DVD-Ig molecules PR-1572102 (lot 2211502), PR-1572105 (lot 2211597), or PR-1610561 (lot 2213329) were administered to huFcRn B6.Cg transgenic mice (5/group) at 5 mg/kg by slow intravenous bolus dose injection. Blood samples were collected from each mouse at 1, 24 and 96 hours and 7, 10, 14 and 21 days post dose. All samples were stored at −80° C. until analysis. DVD-Ig serum concentrations were measured using a Meso Scale Discovery (MSD) electrochemiluminescence (ECL) Ligand Binding Assay. Biotinylated VEGF ligand was coated onto streptavidin MSD plates for capture of anti-VEGF-A/anti-PDGF-BB DVD-Ig molecules from blood samples, and detection was achieved with a sulfo-tag goat anti-human IgG antibody. Concentrations were calculated by four-parameter logistic fit using XLfit4. Pharmacokinetic parameters were calculated with Non-compartmental analysis using Pharmacokinetics Laboratory Automation Software for Management and Analysis (PLASMA) (Version 2.6.12, SParCS, AbbVie).

All three anti-VEGF/PDGF DVD-Ig molecules carrying the H435A substitution had serum concentrations rapidly clear, with measurable concentrations only to 24 hours. These results are in agreement with the rapid clearance observed with other H435A modified antibody and DVD-Ig molecules in human FcRn transgenic mice.

Example 15.2: Pharmacokinetic Properties of Anti-VEGF-A/Anti-PDGF-BB DVD-Ig Molecules Intravitreously Administered in Rabbit Studies were conducted in accordance with the Abbott IACUC guidelines. Female New Zealand White rabbits were used for the ocular pharmacokinetic characterization of Anti-VEGF-A/anti-PDGF-BB DVD-Igs: PR-1572102, PR-1572105 and PR-1610561. Animals (4 animals) were split into two cohorts of two for determination of ocular pharmacokinetics. Samples of aqueous humour were taken at 4, 24, 48, 72, 120, 168, 336 and 504 hours post dosing. With cohort 1 providing samples at 4, 48, 120 and 168 hours, and cohort 2 providing samples at 24, 72, 336 and 504 hours, post dosing. Drug levels in the eye were determined from concentrations in aqueous humour as a surrogate for the vitreous concentrations. Vitreous was harvested from each animal as a terminal sample after their last aqueous humour sample. The proportion of aqueous to vitreous concentration was determined from these terminal time points. Blood samples for the harvest of serum used to estimate systemic exposure after vitreous dosing were also collected at 4, 24, 48, 72, 120, and 168 hours post dosing from all animals, and at 336 and 504 hours from the animals in cohort 2. Test articles were dosed into the vitreous compartment at a range of 0.25 to 0.50 mg per eye with a dose volume of no more than 0.050 mL. Only the right eye of each animal was dosed. Prior to dosing, animals were anesthetized with xylazine/ketamine. The eye was prepared by first applying topical analgesic drops (procaine HCl Ophthalmic solution, 0.5%), then the injections site was swabbed with a saturated povidone-iodine swabstick (10% solution equivalent to 1% available iodine) prior to injection. The intravitreal dose was administered with a 26 gauge needle. The point of entry for the injection was 1-2 mm from the limbus through the sclera. After injection, a sterile cotton eye spear was placed on the injection site and held for 30 seconds to prevent leakage Animals were anesthetized for aqueous fluid collection. At the selected time points after dosing, the aqueous fluid was collected using a 30 gauge needle inserted through the cornea. The needle was advanced just past the bevel and fluid was collected. The samples provided approximately 0.05-0.1 mL of aqueous humour per sampling period. At the selected time points after dosing, blood samples were obtained from an ear vein or artery. Hemostasis following collection was achieved by the application of manual pressure and topical clotting factor or tissue glue as needed. The samples were from 0.5-1 ml in volume, and were allowed to clot for harvest of serum. Aqueous, vitreous and serum samples were stored at −80° C., and submitted for drug level determinations.

All DVD-Ig serum concentrations were measured using a GYROS method employing biotinylated VEGF ligand for capture, and Alexa Flour 647 goat anti-human IgG detection. Concentrations were calculated by four-parameter logistic fit using XLfit4. Pharmacokinetic parameters were calculated with Non-compartmental analysis using Pharmacokinetics Laboratory Automation Software for Management and Analysis (PLASMA) (Version 2.6.12, SParCS, AbbVie).

TABLE 87

Ocular Half Lives in Rabbit from Analysis of Aqueous Humor

| Experiment | Test Article | Corporate ID | Half life (hours) |
|---|---|---|---|
| #1 | 9E10.1_GS_CL-33675 | PR-1610561 | 111 |
| #2 | 9E10.1_GS_CL-33675 | PR-1610561 | Pending |

Example 15.3: Pharmacokinetic Properties of Anti-VEGF-A/Anti-PDGF-BB DVD-Ig Molecules Intravenously Administered in Cynomolgus Monkey Studies are conducted in accordance with the AbbVie IACUC guidelines. Female cynomolgus are used for the systemic pharmacokinetic characterization of Anti-VEGF-A/anti-PDGF-BB DVD-Igs, including PR-1572102, PR-1572105 and PR-1610561 after intravenous dosing. Monkeys are dosed intravenously at 5 mg/kg by slow bolus into the saphenous vein over approximately 2 minutes with a volume of 0.5 mL/kg. Samples are taken for determination of the pharmacokinetics of the test compounds at 0, 0.08, 4, 8, 24, 72, 168, 240, 336, 504 and 672 hours post dosing. At the selected time points after dosing, blood samples are obtained from a femoral vein. Hemostasis following collection is achieved by the application of manual pressure and topical clotting factor or tissue glue as needed. The samples may be approximately 1 ml in volume, and are allowed to clot for harvest of serum. Serum samples are stored at −80° C., and submitted for drug level determinations.

DVD-Ig serum concentrations are measured using either a GYROS or a MSD method. GYROS employs biotinylated VEGF ligand for capture, and Alexa Flour 647 goat anti-human IgG detection. MSD employs biotinylated VEGF ligand for capture, and Sulfo-tag goat anti-human IgG or sulfo-tag VEGF for detection. Concentrations are calculated by four-parameter logistic fit using XLfit4. Pharmacokinetic parameters are calculated with Non-compartmental analysis using Pharmacokinetics Laboratory Automation Software for Management and Analysis (PLASMA) (Version 2.6.12, SParCS, AbbVie).

Example 15.4: Pharmacokinetic Properties of Anti-VEGF-A/Anti-PDGF-BB DVD-Ig Molecules Intravitreously Administered in Cynomolgus Monkey Studies are conducted in accordance with the AbbVie IACUC guidelines. Female cynomolgus are used for the ocular pharmacokinetic characterization of Anti-VEGF-A/anti-PDGF-BB DVD-Igs, including PR-1572102, PR-1572105 and PR-1610561. Animals (4 animals) are split into two cohorts of two for determination of ocular pharmacokinetics. Samples of aqueous humour are taken at 4, 24, 48, 72, 120, 168, 336 and 504 hours post dosing. With cohort 1 providing samples at 4, 48, 120 and 168 hours, and cohort 2 providing samples at 24, 72, 336 and 504 hours, post dosing. Drug levels in the eye are determined from concentrations in aqueous humour as a surrogate for the vitreous concentrations. Blood samples for the harvest of serum used to estimate systemic exposure after vitreous dosing are also collected at 4, 24, 48, 72, 120, and 168 hours post dosing from all animals, and at 336 and 504 hours from the animals in cohort 2. Test articles are dosed into the vitreous compartment at a range of 0.25 to 0.50 mg per eye with a dose volume of no more than 0.050 mL. Only the right eye of each animal is dosed. Prior to dosing, animals are anesthetized with xylazine/ketamine. The eye is prepared by first applying topical analgesic drops (procaine HCl Ophthalmic solution, 0.5%), then the injections site is swabbed with a saturated povidone-iodine swabstick (10% solution equivalent to 1% available iodine) prior to injection. The intravitreal dose is administered with a 26 gauge needle. The point of entry for the injection is 1-2 mm from the limbus through the sclera. After injection, a sterile cotton eye spear is placed on the injection site and held for 30 seconds to prevent leakage. Animals are anesthetized for aqueous fluid collection. At the selected time points after dosing, the aqueous fluid is collected using a 30 gauge needle inserted through the cornea. The needle is advanced just past the bevel and fluid was collected. The samples provide approximately 0.05-0.1 mL of aqueous humour per sampling period. At the selected time points after dosing, blood samples are obtained from an ear vein or artery. Hemostasis following collection is achieved by the application of manual pressure and topical clotting factor or tissue glue as needed. The samples are approximately 1 ml in volume, and are allowed to clot for harvest of serum. Aqueous, vitreous and serum samples are stored at −80° C., and submitted for drug level determinations.

DVD-Ig serum concentrations are measured using either a GYROS or a MSD method. GYROS employs biotinylated VEGF ligand for capture, and Alexa Flour 647 goat anti-human IgG detection. MSD employs biotinylated VEGF ligand for capture, and Sulfo-tag goat anti-human IgG or sulfo-tag VEGF for detection. Concentrations are calculated by four-parameter logistic fit using XLfit4. Pharmacokinetic parameters are calculated with Non-compartmental analysis using Pharmacokinetics Laboratory Automation Software for Management and Analysis (PLASMA) (Version 2.6.12, SParCS, AbbVie).

Example 16: Efficacy of Anti-VEGF-A/Anti-PDGF-BB DVD-Ig Molecules Human VEGF Transgenic Mice Example 16.1: Efficacy of Anti-VEGF-A/Anti-PDGF-BB DVD-Ig Molecules to Inhibit Subretinal Neovascularization in Rho/huVEGF Transgenic Mice Transgenic mice in which the rhodopsin promoter drives expression of human $VEGF_{165}$ in photoreceptors (Rho-VEGF mice) have onset of VEGF expression at P7 and starting at P10, develop sprouts of NV from the deep capillary bed of the retina that grow through the photoreceptor layer and form an extensive network of new vessels in the subretinal space. Since the new vessels originate from retinal capillaries and not choroidal vessels, it is technically a model of retinal angiomatous proliferation (RAP) which occurs in roughly 30% of patients with neovascular AMD, but in general it mimics critical features of wet AMD. At P14, hemizygous Rho-VEGF mice were given an intraocular injection of test reagents. At P21, the mice were euthanized, and eyes were fixed in 10% phosphate-buffered formalin for 2 hours. Retinas were dissected, blocked with 5% normal swine serum in PBS for 1 hour, stained with FITC-conjugated GSA, a vascular stain, for 2 hours to stain vascular cells, flat mounted with the photoreceptor side up, and examined by fluorescence microscopy. The area of subretinal NV was measured with image analysis by an investigator blinded with respect to treatment group. The other eye will provide information regarding systemic effect of an intraocular injection.

Figure 4:
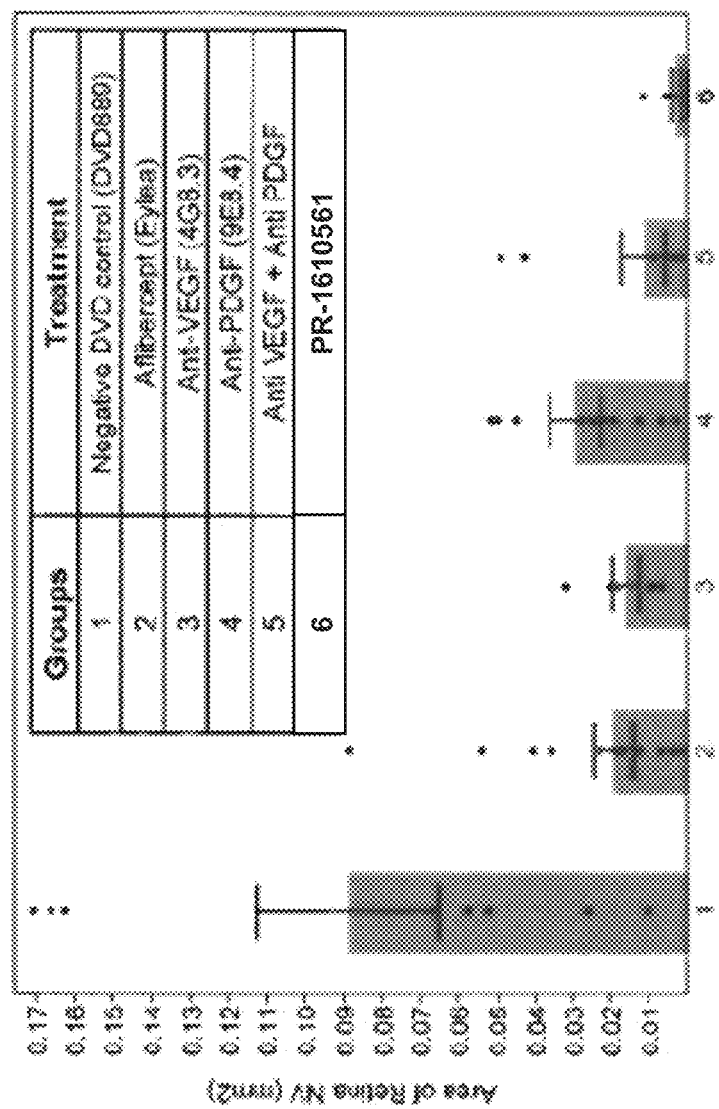
FIG. 4 is a bar graph showing the area of subretinal neovascularization in Rho/huVEGF transgenic mice.

In the study below, nine treatment groups were evaluated: DVD-Ig Control (DVD 889), Eylea, Anti VEGF mAb, Anti PDGF mAb, Anti VEGF+Anti PDGF (combination Ab treatment), Anti-VEGF/anti-PDGF DVD-Ig. Only eye measurements in the experimental eye were analyzed and reported here using one way ANOVA analysis. Posthoc comparison of treatment vs the DVD control groups was analysed by Dunnett's test. Results are shown in See FIG. 4 and in Table 88 below. Further, differences in PDGF neutralization potencies and the molecular size of the DVD-Ig versus IgG did not have an effect in this model.

An overall ANOVA F-test for significance was used and the data was shown to be significant ($p<0.0001$). Comparison of the test groups to the DVD-Ig control group shows that the difference from all the groups was significant (Dunnet test $p<0.0001$). PR-1610561 was significantly more effective at inhibiting subretinal neovascularization in Rho/ huVEGF transgenic mice than Eylea (Tukey HSD test pvalue=0.0031). PR-1610561 was more effective, but not significantly different from, the anti-VEGF and anti-PDGF (potency matched mAbs) combination group.

TABLE 88

Inhibition Efficacy of Anti-VEGF-A, Anti-PDGF-BB, Anti-VEGF-A + Anti-PDGF-BB, and Anti-VEGF-A/Anti-PDGF-BB DVD-Ig Molecules to Subretinal Neovascularization in Rho/huVEGF Transgenic Mice

| Groups | Corporate ID# | N (# of animals) | Mean | Std Dev | Std Err | CV (%) |
|---|---|---|---|---|---|---|
| DVD negative control | PR-1250499 | 8 | 0.0892 | 0.0665 | 0.0235 | 74 |
| Eylea | — | 19 | 0.0198 | 0.0224 | 0.0051 | 113 |
| Anti VEGF | — | 7 | 0.0164 | 0.0088 | 0.0033 | 54 |
| Anti PDGF | — | 16 | 0.0297 | 0.0265 | 0.0066 | 89 |
| Anti VEGF + Anti PDGF | — | 10 | 0.0119 | 0.0182 | 0.0058 | 153 |
| Anti-VEGF/anti-PDGF DVD-Ig | PR-1610561 | 9 | 0.0033 | 0.0038 | 0.0013 | 115 |

Example 16.2: Efficacy of Anti-VEGF-A/Anti-PDGF-BB DVD-Ig Molecules in Tet-Opsin-Human $VEGF_{165}$ Double-Transgenic Mice When given injections of doxycycline, Tet-opsin-VEGF double-transgenic mice with Dox-inducible expression of VEGF express 10-fold higher levels of human $VEGF_{165}$ than Rho-VEGF-transgenic mice and develop severe NV and exudative retinal detachments within 3 to 5 days. Tet-opsin-VEGF mice provide a severe model where mice develop exudative retinal detachments and only the most effective agents have a significant impact. Double-hemizygous Tet-opsin-VEGF mice were given intraocular injections of test reagent in the right eyes. For the next 3 days, the mice were also administered a daily subcutaneous injection of 50 mg/kg doxycycline. At the 4th day, mice were euthanized and fundus photographs taken with Micron III retinal imaging microscope (Phoenix Research Laboratories, Pleasanton, Calif.). Also, OCT images were taken by Bioptigen Image-guided OCT (Envisu R4110, Bioptigen Inc. Morrisville, N.C.). Then eyes were frozen in optimal cutting temperature embedding solution. Ten-micron ocular serial sections were cut through the entire eye, stained with H&E stain and examined by light microscopy. After that mean length of the retinal detachment per section was measured with image analysis by an investigator blinded with respect to treatment group. The percentage of the detached retina was computed. Retinal detachment was graded as no detachment (0); partial retinal detachment (1); or total retinal detachment (2).

Anti-VEGF-A, anti-PDGF-BB, and the combination of anti-VEGF-A and anti-PDGF-BB were tested for their ability to suppress retinal detachment (RD) in tet-opsin-VEGF double transgenic mice. Results showed differences among the 3 test groups (P=0.01, Kruskal-Wallis test). Based on the RD number, the combination of anti-VEGF-A and anti-PDGF-BB (7 NRD, 1 PRD, 0 TRD), and the anti-VEGF-A alone (5 NRD, 0 PRD, 0 TRD) groups were more effective than anti-PDGF-BB alone (2 NRD, 2 PRD, 2 TRD) in preventing RD in Tet-opsin-VEGF double transgenic mice.

The differences in efficacy between PR-1610561, Eylea, and control IgG were compared next in tet-opsin-VEGF mice. Differences were also found among the 3 groups (P=0.01, Kruskal-Wallis test). PR-1610561 (10 NRD, 0 PRD, 1 TRD) and Eylea (4 NRD, 3 PRD, 1 TRD) were more effective than IgG control (2 NRD, 2 PRD, 2 TRD) in preventing RD in Tet-opsin-VEGF double transgenic mice. The data is summarized in Table 89 below.

TABLE 89

The efficacy of test articles in tet-opsin-VEGF double transgenic mice

| Grade | IgG control | Anti-VEGF mAb | Anti-PDGF mAb | Anti-VEGF + Anti-PDGF | PR-1610561 | Eylea |
|---|---|---|---|---|---|---|
| 0 (NRD) | 2 | 5 | 2 | 7 | 10 | 4 |
| 1 (PRD) | 1 | 0 | 2 | 1 | 0 | 3 |
| 2 (TRD) | 6 | 0 | 3 | 0 | 1 | 1 |
| Total eyes | 9 | 5 | 7 | 8 | 11 | 8 |

The effects of PR-1610561 in a tet/opsin/huVEGF double transgenic mouse retinal detachment model were also analyzed by another grading system (Table 89A). 1 µl of reagent was injected into one eye, followed by subcutaneous injection of doxycycline at 500 mg/kg once a day for three days, and then fundus images and OCTs were done at day 4. Retinal detachment was graded as no detachment (0); no retinal detachment but at least one sign selected from dilated retinal vessels, retinal edema, or hemorrhage (1); one or less than one quadrant of retinal detachment (2); two or three quandrants of retinal detachment or shallow pan retinal detachment (3); or severe bullous retinal detachment (4).

TABLE 89A

Efficacy of Anti-VEGF, Anti-PDGF, Anti-VEGF + Anti-PDGF, and Anti-VEGF/Anti-PDGF DVD-Ig Molecules in Tet/Opsin/huVEGF Double Transgenic Mice

| Grade | DVD889 | Anti-VEGF | Anti-PDGF | Combo | PR-1610561 | Aflibercept |
|---|---|---|---|---|---|---|
| 0 | 1 | 4 | 1 | 4 | 3 | 1 |
| 1 | 1 | 1 | 1 | 2 | 7 | 3 |
| 2 | 1 | 0 | 2 | 0 | 0 | 1 |
| 3 | 0 | 0 | 0 | 1 | 1 | 1 |
| 4 | 6 | 0 | 3 | 0 | 0 | 1 |
| Total eyes evaluated | 9 | 5 | 7 | 8 | 11 | 7 |

The results in the tables above show that PR-1610561 has similar efficacy to a combination of anti-VEGF-A and anti-PDGF-BB, and is superior to Aflibercept alone in suppressing subretinal neovascularization in Rho/huVEGF transgenic mice. PR-1610561 is also superior to the combination of Aflibercept and anti-PDGF-BB in the prevention of vascular leakage in Rho/huVEGF transgenic mice.

Example 16.3: Effects of Anti-VEGF/Anti-PDGF on Ocular Neovascularization and Vascular Permeability/Perfusion This study compared the effects of intraocular injections of anti-VEGF/anti-PDGF DVD-Ig molecules, anti-VEGF mAb alone, anti-PDGF alone, and a combination of antibodies.

DVD-Ig molecules and DVD-Ig Fab fragments were selected for evaluation, first in Rho/VEGF mice and then in Tet/opsin/VEGF double transgenic mice.

Studies used rho/VEGF and Tet/opsin/VEGF mouse models as described in Example 16.1. The compounds evaluated are shown in Table 90 below. About 20 mice were included per experiment, where one eye was injected with agent and the other eye was not injected.

TABLE 90

Study Agents

4G8.3-GS-9E8.4 (PR-1572102; DVD-Ig-1)
4G8.3-LS-9E8.4 (PR-PR-1575573; DVD-Ig-2)
4G8.3-SL-9E8.4 (PR-1572105; DVD-Ig-3)
DVD 889(IgG control)
Anti-VEGF IgG 4G83
Anti-PDGF-BB IgG 9E8.4
Anti-VEGF IgG 24 µg + Anti-PDGF-BB IgG
Avastin 24 µg
Anti-PDGF-BB aptamer E10030.1
Avastin 24 µg + Anti-PDGF-BB aptamer Transgenic mice in which the rhodopsin promoter drives expression of VEGF in photoreceptors (rho/VEGF mice) develop retinal angiomatous proliferation (RAP) which originates from the deep capillary bed of the retina and grows through the photoreceptor layer to reach the subretinal spaces. The transgenic mice were utilized to determine the effects of DVD-Ig molecules on subretinal neovascularization. The rho/VEGF mice have an onset of VEGF expression at P7 and, starting at P10, develop sprouts of NV from the deep capillary bed of the retina that grow through the photoreceptor layer and form an extensive network of new vessels in the subretinal space. At P14, hemizygous Rho-VEGF mice were given an intraocular injection of test reagents. At P21, the mice were euthanized, and eyes were fixed in 10% phosphate-buffered formalin for 2 hours. Retinas were dissected, blocked with 5% normal swine serum in PBS for 1 hour, stained with FITC-conjugated GSA for 2 hours to stain vascular cells, flat mounted with the photoreceptor side up, and examined by fluorescence microscopy. The area of subretinal NV was measured with image analysis by an investigator blinded with respect to treatment group.

Figure 5:
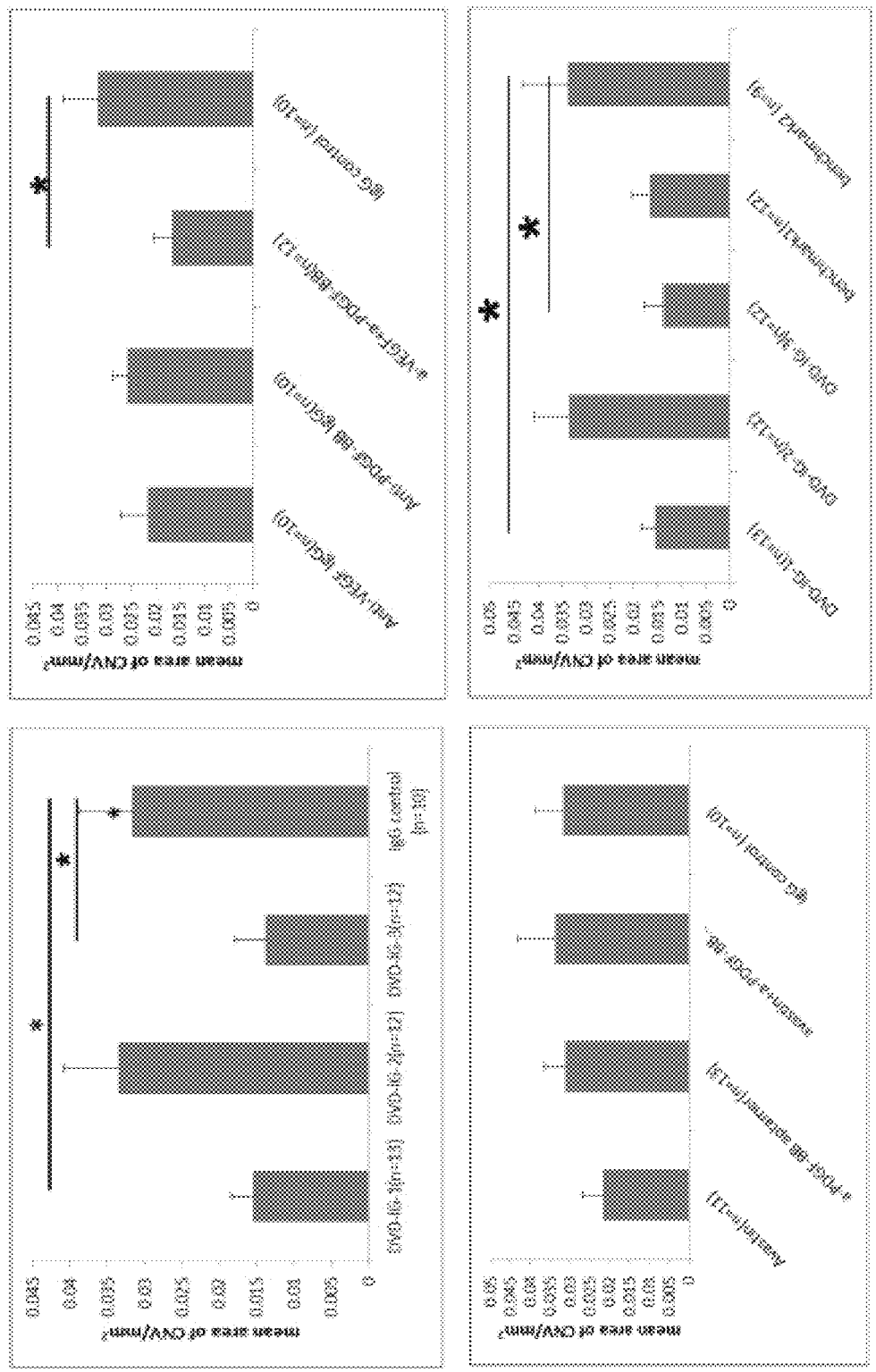
FIG. 5 is a bar graph showing the area of choroidal neovascularization in Rho/huVEGF transgenic mice.

Compared with the control DVD-Ig molecule, DVD-Ig-1 and DVD-Ig-3 significantly decreased choroidal neovascularization (CNV) ($p=0.02, 0.04$), whereas DVD-Ig-2 did not show much effect. Compared with the IgG control, the combined administration of anti-VEGF IgG and anti-PDGF-BB IgG significantly decreased CNV ($p=0.045$), while administration of anti-VEGF IgG or anti-PDGF IgG alone did not significantly reduce subretinal NV. No other difference was observed in eyes injected with Avastin, anti-PDGF-BB aptamer, or a mixture of Avastin and anti-PDGF-BB aptamer. Significantly decreased subretinal NV was found after administration of DVD-Ig-1 and DVD-Ig-3, when compared to the mixture of Avastin and the anti-PDGF-BB aptamer. No other difference was found between DVD-Ig reagents and the combined administration of anti-VEGF-IgG and anti-PDGF IgG. FIG. 5.

Figure 6:
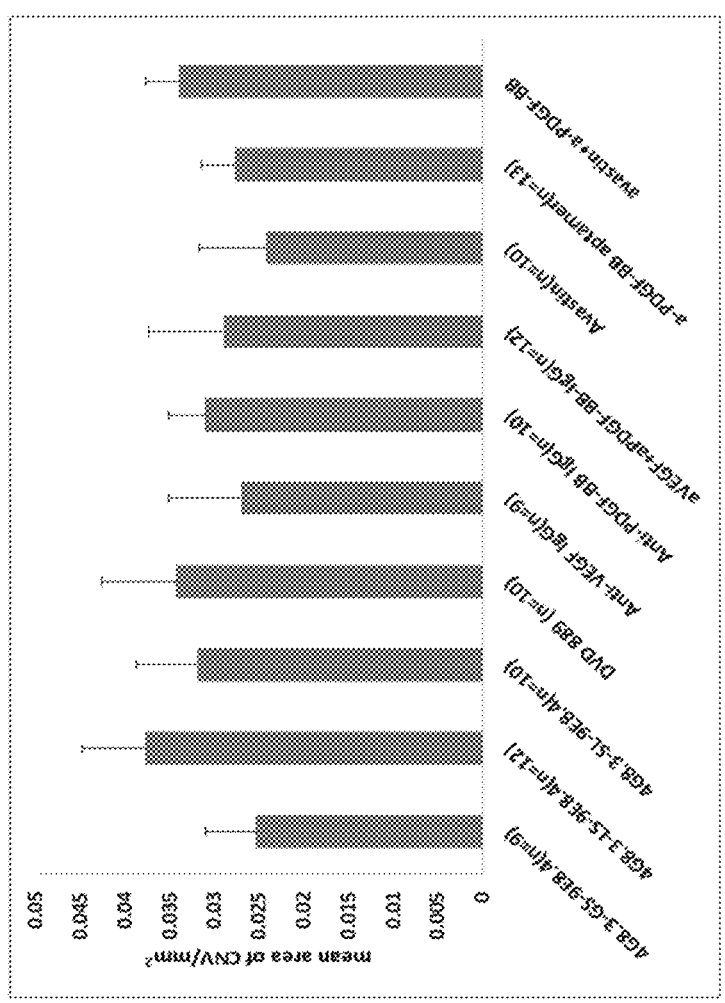
FIG. 6 is a bar graph comparing choroidal neovascularization in the untreated eye among the different treatment groups.

No difference was found in the untreated eyes of mice injected with anti-VEGF/anti-PDGF DVD-Ig molecules, control DVD-Ig, anti-VEGF mAb alone, anti-PDGF alone, and a combination of antibodies (ANOVA, $P>0.05$), indicating there was no clear systemic effect of intraocular injection. FIG. 6.

Tet/opsin/VEGF mice express higher levels of VEGF in photoreceptors than rho/VEGF mice, resulting in severe NV and vascular leakage with exudative retinal detachment. The efficacy of intraocular injections of anti-VEGF/anti-PDGF DVD-Ig molecules in this transgenic mouse was also evaluated. Mice were given intraocular injections of test reagent in the right eye. For the next 3 days, the mice were also administered a daily subcutaneous injection of 50 mg/kg doxycycline. At the 4th days, mice were euthanized and fundus photographs were taken with Micron III retinal imaging microscope (Phoenix Research Laboratories, Pleasanton, Calif.). OCT images were taken by Bioptigen Image-guided OCT (Envisu R4110, Bioptigen Inc. Morrisville, N.C.). Then eyes were frozen in optimal cutting temperature embedding solution. Ten-micron ocular serial sections were cut through the entire eye, stained with H&E stain and examined by light microscopy. Mean length of the retinal detachment per section was measured with image analysis by an investigator blinded with respect to treatment group. The percentage of the retina that was detached was computed.

Figure 7:
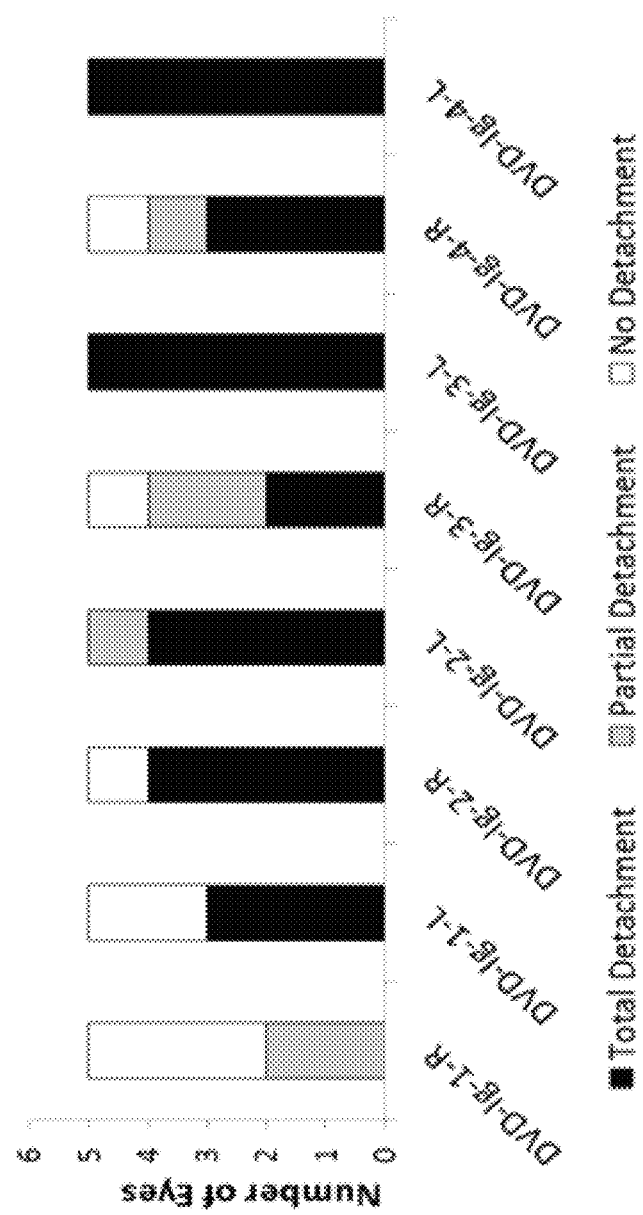
FIG. 7 is a bar graph showing number of partial, total, and undetached eyes in Tet/opsin/VEGF mice.

Five mice in each test group were injected with DVD-Ig reagents separately. In DVD-Ig-1 injected eyes, two were not detached and three were partially detached, while three eyes were totally detached and two partially detached in the uninjected eye. In DVD-Ig-3 injected eyes, one was not detached, two were partially detached, and two were totally detached, while all the uninjected eyes were totally detached. In the DVD-Ig-2 injected eyes, one was not detached and four were totally detached, while one eye was partially detached and four eyes were totally detached in the uninjected eye. In the IgG control group, one injected eye was not detached, one eye was partially detached, and three eyes were totally detached, while all eyes were totally detached in the uninjected eye. FIG. 7.

Thus, DVD-Ig-1 and DVD-Ig-3 appeared to perform at least as well as a combination of anti-VEGF mAb and anti-PDGF mAb for the measured parameters, while requiring the administration of only one compound.

Example 17: Generation and Identification of Various Molecular Formats Optimal for Applications in Ocular Diseases Several attributes were considered in the design of a therapeutic biologic for the treatment of wet AMD:

PK, Efficacy and Frequency of Administration:

Longer ocular duration may support less frequent intravitreous injection. The size of the administered molecule may play a role in determining ocular half-life. This is supported by consistently longer ocular half-life for the current anti-VEGF agents with larger molecular size in humans and in experimental animals. Bevacizumab, which has a larger molecular size (150 kDa) than ranibizumab (49 kDa), also seems to have more robust duration of efficacy in both Rho/huVEGF and tet/huVEGF transgenic mice, the two models used for preclinical efficacy.

FcRn and FcγR Binding and Safety:

Fc neonatal receptor (FcRn), which plays a role for long circulating half-life of IgG molecules in serum, may or may not play an important role in determining ocular half-life. The molecules with wild type FcRn binding, however, will have long systemic half-life and may increase safety risk due to unnecessary systemic exposure of intravitreously injected molecules. FcRn is also perceived to play a role in active efflux of IgGs across blood-retina barrier. This may lead to shortened ocular retention time for the intravitreously inject molecules. Effector functions are not needed for the efficacy of anti-wet AMD agents. But both VEGF-A and PDGF-BB may be associated with extracellular matrix when they are initially synthesized and secreted. The ECM-associated VEGF-A and PDGF-BB therefore may potentially mediate effector functions.

Affinity, Valency and Potency:

Both VEGF-A and PDGF-BB are homodimeric molecules. If a monovalent molecular format similar to that of ranibizumab (Fab) is used for bispecific molecules targeting VEGF and PDGF for the treatment of wet AMD, high affinity may be needed to maintain binding and potent neutralization of both VEGF-A and PDGF-BB.

Manufacturability:

Any viable format needs to have acceptable expression, purification, formulation properties to accommodate DS and DP manufacturing.

Various binding protein formats disclosed herein may satisfy these characteristics:
(1) Full length DVD-Ig [L234A, L235A] (200 kDa, lacks binding to FcgRs)
(2) Full length DVD-Ig [L234A, L235A, H435A] (200 kDa, lacks binding to FcgRs and FcRn)
(3) Half DVD-Ig (100 kDa, lacks binding to FcgRs and FcRn)
(4) DVD-Fab (75 kDa, no Fc)

Example 17.1: Generation of Various Molecular Formats Including DVD-Ig [L234A, L235A], DVD-Ig [L234A, L235A and H435A], DVD-Ig [L234A, L235A and H435R], Half DVD-Ig and DVD-Fab This example evaluates the impact of Fc mutations on the PK properties of DVD-Ig binding proteins. DVD-038 was used a tool molecule to study various DVD-Ig formats, including a half-DVD-Ig (DVD038 [L234A, L235A] Half-DVD), full DVD-Ig binding proteins having three constant domain mutations (DVD038 [L234A, L235A and H435A] and DVD038 [L234A, L235A and H435R]), and a full DVD-Ig binding protein having two constant domain mutations (DVD038 [L234A, L235A]). The data below was used to evaluate options for producing a VEGF/PDGF binding protein structure with good drug-like properties and exhibiting high ocular duration but low systemic circulation. DVD038 is a dual variable domain binding protein that binds HER2 and VEGF.

To prepare mutants of DVD038, overlapping PCR was used with primers designed to include the desired mutations. PCR products were digested and ligated into the cloning vector. Bacterial transformation was performed to identify positive clones and constructs were harvested and purified for use in mammalian transfection using standard protocols known in the art.

All variants were transiently transfected into 10 L of HEK 293 6E suspension cell cultures in a Wave-bag with a ratio of 60% to 40% light to heavy chain construct. 0.5 mg/mL PEI was used to transfect the cells. Supernatants were harvested after 11 days by centrifugation at 16000 g for 20 minutes followed by filtration using Pall Serum Capsule and Pall AcroPak 1000. All except DVD-Fab were purified on MabSelectSuRe resin (GE Healthcare, 17-5438-04). Following equilibration with PBS pH 7.4, the supernatant was loaded on the resin and washed with PBS pH 7.4. DVD-Ig protein was eluted with 50 mM Glycine, 50 mM NaCl pH 3.5. DVD-Fab was purified using Protein G Sepharose 4 FF resin (GE Healthcare, 17-0618-04). Elution was performed with Immunopure IgG elution buffer (Pierce, 185 1520). Fractions containing DVD-Ig were pooled and dialyzed in 30 mM Histidine pH 6, 8% sucrose overnight at 4° C.

Example 17.2: Binding of Various Formats to FcRns from Different Species

As described in Example 1.2, all variants of DVD038, except for DVD038 Fab which does not have an Fc region, were analyzed for their binding to FcRns from different species. The data is summarized in Table 91 below.

TABLE 91

Binding of Various Formats to FcRns from Different Species

| Test Articles | Corporate ID | Hu FcRn KD (M) | Cyno FcRn KD (M) | Rabbit FcRn KD (M) | Rat FcRn ka (1/Ms) | Rat FcRn kd (1/s) | Rat FcRn KD (M) |
|---|---|---|---|---|---|---|---|
| DVD038 (L234A, L235A) Half DVD-Ig | PR-1578399 | 6.26E−06 | 3.13E−06 | 6.76E−07 | 3.06E+04 | 2.57E−02 | 8.40E−07 |
| DVD038 (L234A, L235A, H435R) | PR-1564681 | 7.96E−06 | 2.57E−06 | 3.98E−07 | 5.15E+04 | 5.53E−02 | 1.07E−06 |
| DVD038 (L234A, L235A) | PR-1565009 | 4.90E−06 | 1.74E−06 | 2.75E−07 | 3.66E+04 | 1.94E−02 | 5.31E−07 |
| DVD038 (L234A, L235A, H435A) | PR-1565689 | NSB | NSB | NSB | | NSB | |
| HERCEPTIN | — | 4.53E−06 | 2.62E−06 | 4.69E−07 | 3.27E+04 | 1.81E−02 | 5.55E−07 |

* NSB = no significant binding

Example 17.3: Pharmacokinetic Properties of Different Formats in huFcRn Transgenic Mice Administered Intravenously Studies were conducted in accordance with the Abbott IACUC guidelines. DVD038 (L234A, L235A) (PR-1565009), DVD038 (L234A, L235A, H435R) (PR-1564681), and DVD038 (L234A, L235A, H435A) (PR-1565689) were administered to huFcRn transgenic mice (5/group) at 6.7 mg/kg by slow intravenous bolus dose injection. Blood samples were collected from each mouse at 1, 24 and 96 hours and 7, 10, 14 and 21 days post dose. All samples were stored at −80° C. until analysis. DVD-Ig serum concentrations were measured using a Meso Scale Discovery (MSD) electrochemiluminescence (ECL) Ligand Binding Assay. Biotinylated VEGF ligand was coated onto streptavidin MSD plates for capture of anti-VEGF-A/anti-PDGF-BB DVD-Ig molecules from blood samples, and detection was achieved with a sulfo-tag goat anti-human IgG antibody. Concentrations were calculated by four-parameter logistic fit using XLfit4. Pharmacokinetic parameters were calculated with Non-compartmental analysis using Pharmacokinetics Laboratory Automation Software for Management and Analysis (PLASMA) (Version 2.6.12, SParCS, AbbVie).

TABLE 92

PK in huFcRn Transgenic Mice

| Test Articles | Corporate ID | T½ (d) | CL (mL/h/kg) |
|---|---|---|---|
| DVD038 (L234A, L235A) | PR-1565009 | 2.8 | 0.81 |
| DVD038 (L234A, L235A, H435R) | PR-1564681 | 1.8 | 1.25 |
| DVD038 (L234A, L235A, H435A) | PR-1565689 | 0.6 | 1.58 |

The results demonstrate a trend for increased clearance and shorter half-life for DVD constructs with reduced or lack of Fc binding in huFcRn transgenic mice.

Example 17.4: Pharmacokinetic Properties of Different Formats in CD-1 Mice Administered Intravenously Studies were conducted in accordance with the Abbott IACUC guidelines. DVD038 (L234A, L235A) (PR-1565009), DVD038 (L234A, L235A, H435R) (PR-1564681), DVD038 (L234A, L235A, H435A) (PR-1565689), DVD038 half DVD-Ig (L234A, L235A) (PR-1578399) and DVD-Fab (PR-1574215) were administered to CD-1 mice (5/group) at 6.7 mg/kg by slow intravenous bolus dose injection. Blood samples were collected from each mouse at 1, 24 and 96 hours and 7, 10, 14 and 21 days post dose. All samples were stored at −80° C. until analysis. DVD-Ig serum concentrations were measured using a Meso Scale Discovery (MSD) electrochemiluminescence (ECL) Ligand Binding Assay. Biotinylated VEGF ligand was coated onto streptavidin MSD plates for capture of anti-VEGF-A/anti-PDGF-BB DVD-Ig molecules from blood samples, and detection was achieved with a sulfo-tag goat anti-human IgG antibody. Concentrations were calculated by four-parameter logistic fit using XLfit4. Pharmacokinetic parameters were calculated with Non-compartmental analysis using Pharmacokinetics Laboratory Automation Software for Management and Analysis (PLASMA) (Version 2.6.12, SParCS, AbbVie).

TABLE 93

PK in CD-1 Mice

| Test Articles | Corporate ID | T½ (d) | CL (mL/h/kg) |
|---|---|---|---|
| DVD038 (L234A, L235A) | PR-1565009 | 7.6 | 0.46 |
| DVD038 (L234A, L235A, H435R) | PR-1564681 | 6.4 | 0.29 |
| DVD038 (L234A, L235A, H435A) | PR-1565689 | 2.7 | 0.73 |
| DVD038 Half DVD-Ig (L234A, L235A) | PR-1578399 | 0.4 | 8.86 |
| DVD038 DVD-Fab | PR-1574215 | 0.2 | 20.76 |

Results demonstrate a trend for increased clearance and shorter half-life for DVD constructs with reduced or lack of Fc binding in CD-1 mice. Molecules composed of a fragment of immunoglobulin structure are cleared fastest.

Example 17.5: Pharmacokinetic Properties of Different Formats in Rabbits Administered Intravitreously Studies were conducted in accordance with the AbbVie IACUC guidelines. Female New Zealand White rabbits were used for the ocular pharmacokinetic characterization of formats DVD038 (PR-1565009, lot 2131983), DVD038 H435A (PR-1565689, lot 2131481), DVD038 Dhab (PR-1578399, lot 2149586) and DVDFab (PR-1574215, lot 2143755). Animals (4 animals) were split into two cohorts of two for determination of ocular pharmacokinetics. Samples of aqueous humour were taken at 48, 168, 336 and 504 hours post dosing. With cohort 1 providing samples at 48 and 168 hours, and cohort 2 providing samples at 336 and 504 hours, post dosing. Drug levels in the eye were determined from concentrations in aqueous humour. Blood samples for the harvest of serum used to estimate systemic exposure after vitreous dosing were also collected at 4, 24, 48, 72, 120, 168 hours post dosing from all animals, and at 336 and 504 hours from the animals in cohort 2. Test articles were dosed into the vitreous compartment at 0.50 mg per eye with a volume of no more than 0.050 mL. Only the right eye of each animal was dosed. Prior to dosing, animals were anesthetized with xylazine/ketamine. The eye was prepared by first applying topical analgesic drops (procaine HCl Ophthalmic solution, 0.5%), then the injections site was swabbed with a saturated povidone-iodine swab stick (10% solution equivalent to 1% available iodine) prior to injection. The intravitreal dose was administered with a 26 gauge needle. The point of entry for the injection was 1-2 mm from the limbus through the sclera. After injection, a sterile cotton eye spear was placed on the injection site and held for 30 seconds to prevent leakage. Animals were anesthetized for aqueous fluid collection. At the selected time points after dosing, the aqueous fluid was collected using a 30 gauge needle inserted through the cornea. The needle was advanced just past the bevel and fluid was collected. The samples provided approximately 0.05-0.1 mL of aqueous humour per sampling period. At the selected time points after dosing, blood samples were obtained from an ear vein or artery. Hemostasis following collection was achieved by the application of manual pressure and topical clotting factor or tissue glue as needed. The samples were from 0.5-1 ml in volume, and were allowed to clot for harvest of serum. Aqueous, vitreous and serum samples were stored at −80° C., and submitted for drug level determinations.

The serum, and aqueous humour concentrations for these molecules were measured using either a GYROS or a MSD method. GYROS employs a biotinylated VEGF ligand for capture, and Alexa Flour 647 goat anti-human IgG detection. MSD employs biotinylated VEGF ligand for capture, and Sulfo-tag goat anti-human IgG or sulfo-tag VEGF for detection. Results were comparable between the two methods. Concentrations were calculated by four-parameter logistic fit using XLfit4. Pharmacokinetic parameters were calculated with Non-compartmental analysis using Pharmacokinetics Laboratory Automation Software for Management and Analysis (PLASMA) (Version 2.6.12, SParCS, AbbVie). Results from the experiment are shown in Table 94.

TABLE 94

Ocular Half Lives in Rabbit from Analysis of Aqueous Humor

| Test Articles | Corporate ID | Half life |
|---|---|---|
| DVD038 (L234A, L235A) | PR-1565009 | 151 |
| DVD038 (L234A, L235A, H435A) | PR-1565689 | 157 |
| DVD038 Half DVD-Ig (L234A, L235A) | PR-1578399 | 90 |
| DVD038 DVD-Fab | PR-1574215 | 110 |

Population analysis of the pooled data sets was performed on the composite profile from multiple animals at each dose level. The analysis provided parameter estimates with reasonable variability (CV<30%). The larger molecular weight constructs show a weak trend towards a longer ocular half-life.

TABLE 95

Exemplary DVD-Ig Binding Proteins And Component Subunits

| SEQ ID NO | DVD-Ig | Outer VD name | Linker | Inner VD name |
|---|---|---|---|---|
| 45 | PR-1563988H | hBDI-9E8.4 VH (PDGF) (SEQ ID NO: 1) | GS-H10 | hBDB-4G8.3 VH (VEGF) (SEQ ID NO: 17) |
| 46 | PR-1563988L | hBDI-9E8.4 VL (PDGF) (SEQ ID NO: 2) | GS-L10 | hBDB-4G8.3 VL (VEGF) (SEQ ID NO: 18) |
| 47 | PR-1563990H | hBDI-9E8.4 VH (PDGF) (SEQ ID NO: 1) | HG-short | hBDB-4G8.3 VH (VEGF) (SEQ ID NO: 17) |
| 48 | PR-1563990L | hBDI-9E8.4 VL (PDGF) (SEQ ID NO: 2) | LK-short | hBDB-4G8.3 VL (VEGF) (SEQ ID NO: 18) |
| 49 | PR-1563998H | hBDI-9E8.4 VH (PDGF) (SEQ ID NO: 1) | HG-short | hBDB-4G8.3 VH (VEGF) (SEQ ID NO: 17) |
| 50 | PR-1563998L | hBDI-9E8.4 VL (PDGF) (SEQ ID NO: 2) | LK-long | hBDB-4G8.3 VL (VEGF) (SEQ ID NO: 18) |
| 51 | PR-1564009H | hBDI-9E8.4 VH (PDGF) (SEQ ID NO: 1) | HG-long | hBDB-4G8.3 VH (VEGF) (SEQ ID NO: 17) |
| 51 | PR-1564009L | hBDI-9E8.4 VL (PDGF) (SEQ ID NO: 2) | LK-short | hBDB-4G8.3 VL (VEGF) (SEQ ID NO: 18) |
| 53 | PR-1564010H | hBDB-4G8.3 VH (VEGF) (SEQ ID NO: 17) | GS-H10 | hBDI-9E8.4 VH (PDGF) (SEQ ID NO: 1) |
| 54 | PR-1564010L | hBDB-4G8.3 VL (VEGF) (SEQ ID NO: 18) | GS-L10 | hBDI-9E8.4 VL (PDGF) (SEQ ID NO: 2) |
| 55 | PR-1564011H | hBDB-4G8.3 VH (VEGF) (SEQ ID NO: 17) | HG-short | hBDI-9E8.4 VH (PDGF) (SEQ ID NO: 1) |
| 56 | PR-1564011L | hBDB-4G8.3 VL (VEGF) (SEQ ID NO: 18) | LK-short | hBDI-9E8.4 VL (PDGF) (SEQ ID NO: 2) |
| 57 | PR-1564012H | hBDB-4G8.3 VH (VEGF) (SEQ ID NO: 17) | HG-short | hBDI-9E8.4 VH (PDGF) (SEQ ID NO: 1) |
| 58 | PR-1564012L | hBDB-4G8.3 VL (VEGF) (SEQ ID NO: 18) | LK-long | hBDI-9E8.4 VL (PDGF) (SEQ ID NO: 2) |
| 59 | PR-1564013H | hBDB-4G8.3 VH (VEGF) (SEQ ID NO: 17) | HG-long | hBDI-9E8.4 VH (PDGF) (SEQ ID NO: 1) |
| 60 | PR-1564013L | hBDB-4G8.3 VL (VEGF) (SEQ ID NO: 18) | LK-short | hBDI-9E8.4 VL (PDGF) (SEQ ID NO: 2) |
| 61 | PR-1564883H (DVD3896H)a | hBDI-5H1.9 VH (PDGF) (SEQ ID NO: 3) | HG-short | hBDB-4G8.13 VH (VEGF) (SEQ ID NO: 19) |
| 62 | PR-1564883L (DVD3896L)a | hBDI-5H1.9 VL (PDGF) (SEQ ID NO: 4) | LK-long | hBDB-4G8.13 VL (VEGF) (SEQ ID NO: 20) |
| 63 | PR-1564893H (DVD3897H)a | hBDI-5H1.9 VH (PDGF) (SEQ ID NO: 3) | HG-short | hBDB-4G8.14 VH (VEGF) (SEQ ID NO: 21) |
| 64 | PR-1564893L (DVD3897L)a | hBDI-5H1.9 VL (PDGF) (SEQ ID NO: 4) | LK-long | hBDB-4G8.14 VL (VEGF) (SEQ ID NO: 22) |
| 209 | PR-1564896H (DVD3898H)a | hBDI-5H1.9 VH (PDGF) (SEQ ID NO: 3) | HG-short | hBDB-4G8.15 VH (VEGF) (SEQ ID NO: 23) |
| 65 | PR-1564896L (DVD3898L)a | hBDI-5H1.9 VL (PDGF) (SEQ ID NO: 4) | LK-long | hBDB-4G8.15 VL (VEGF) (SEQ ID NO: 24) |
| 66 | PR-1564898H (DVD3899H)a | hBDI-5H1.12 VH (PDGF) (SEQ ID NO: 211) | HG-short | hBDB-4G8.14 VH (VEGF) (SEQ ID NO: 21) |
| 67 | PR-1564898L (DVD3899L)a | hBDI-5H1.12 VL (PDGF) (SEQ ID NO: 212) | LK-long | hBDB-4G8.14 VL (VEGF) (SEQ ID NO: 22) |
| 68 | PR-1564899H (DVD3900H)a | hBDI-5H1.12 VH (PDGF) (SEQ ID NO: 211) | HG-short | hBDB-4G8.15 VH (VEGF) (SEQ ID NO: 23) |
| 69 | PR-1564899L (DVD3900L)a | hBDI-5H1.12 VL (PDGF) (SEQ ID NO: 212) | LK-long | hBDB-4G8.15 VL (VEGF) (SEQ ID NO: 24) |
| 70 | PR-1565023H (DVD3901H)a | hBDI-9E8.9 VH (PDGF) (SEQ ID NO: 7) | HG-short | hBDB-4G8.13 VH (VEGF) (SEQ ID NO: 19) |

TABLE 95-continued

Exemplary DVD-Ig Binding Proteins And Component Subunits

| SEQ ID NO | DVD-Ig | Outer VD name | Linker | Inner VD name |
|---|---|---|---|---|
| 71 | PR-1565023L (DVD3901L)a | hBDI-9E8.9 VL (PDGF) (SEQ ID NO: 8) | LK-long | hBDB-4G8.13 VL (VEGF) (SEQ ID NO: 20) |
| 72 | PR-1565029H (DVD3902H)a | hBDI-9E8.9 VH (PDGF) (SEQ ID NO: 7) | HG-short | hBDB-4G8.14 VH (VEGF) (SEQ ID NO: 21) |
| 73 | PR-1565029L (DVD3902L)a | hBDI-9E8.9 VL (PDGF) (SEQ ID NO: 8) | LK-long | hBDB-4G8.14 VL (VEGF) (SEQ ID NO: 22) |
| 74 | PR-1565030H (DVD3903H)a | hBDI-9E8.9 VH (PDGF) (SEQ ID NO: 7) | HG-short | hBDB-4G8.15 VH (VEGF) (SEQ ID NO: 23) |
| 75 | PR-1565030L (DVD3903L)a | hBDI-9E8.9 VL (PDGF) (SEQ ID NO: 8) | LK-long | hBDB-4G8.15 VL (VEGF) (SEQ ID NO: 24) |
| 76 | PR-1565031H (DVD3904H)a | hBDI-9E8.12 VH (PDGF) (SEQ ID NO: 9) | HG-short | hBDB-4G8.14 VH (VEGF) (SEQ ID NO: 21) |
| 77 | PR-1565031L (DVD3904L)a | hBDI-9E8.12 VL (PDGF) (SEQ ID NO: 10) | LK-long | hBDB-4G8.14 VL (VEGF) (SEQ ID NO: 22) |
| 78 | PR-1565032H (DVD3905H)a | hBDI-9E8.12 VH (PDGF) (SEQ ID NO: 5) | HG-short | hBDB-4G8.15 VH (VEGF) (SEQ ID NO: 23) |
| 79 | PR-1565032L (DVD3905L)a | hBDI-9E8.12 VL (PDGF) (SEQ ID NO: 6) | LK-long | hBDB-4G8.15 VL (VEGF) (SEQ ID NO: 24) |
| 80 | PR-1565035H (DVD3906H)a | hBDI-5H1.10 VH (PDGF) (SEQ ID NO: 9) | HG-short | hBDB-4G8.15 VH (VEGF) (SEQ ID NO: 23) |
| 81 | PR-1565035L (DVD3906L)a | hBDI-5H1.10 VL (PDGF) (SEQ ID NO: 10) | LK-long | hBDB-4G8.15 VL (VEGF) (SEQ ID NO: 24) |
| 82 | PR-1565033H (DVD3907H)a | hBDI-9E8.10 VH (PDGF) (SEQ ID NO: 9) | HG-short | hBDB-4G8.15 VH (VEGF) (SEQ ID NO: 23) |
| 83 | PR-1565033L (DVD3907L)a | hBDI-9E8.10 VL (PDGF) (SEQ ID NO: 10) | LK-long | hBDB-4G8.15 VL (VEGF) (SEQ ID NO: 24) |
| 84 | PR-1569574H | hBDI-9E8.4 VH (PDGF) (SEQ ID NO: 1) | GS-H10 | hBDB-4G8.3 VH (VEGF) (SEQ ID NO: 17) |
| 85 | PR-1569574L | hBDI-9E8.4 VL (PDGF) (SEQ ID NO: 2) | GS-L10 | hBDB-4G8.3 VL (VEGF) (SEQ ID NO: 18) |
| 86 | PR-1569579H | hBDI-9E8.4 VH (PDGF) (SEQ ID NO: 1) | HG-short | hBDB-4G8.3 VH (VEGF) (SEQ ID NO: 17) |
| 87 | PR-1569579L | hBDI-9E8.4 VL (PDGF) (SEQ ID NO: 2) | LK-long | hBDB-4G8.3 VL (VEGF) (SEQ ID NO: 18) |
| 88 | PR-1572102H | hBDB-4G8.3 VH (VEGF) (SEQ ID NO: 17) | GS-H10 | hBDI-9E8.4 VH (PDGF) (SEQ ID NO: 1) |
| 89 | PR-1572102L | hBDB-4G8.3 VL (VEGF) (SEQ ID NO: 18) | GS-L10 | hBDI-9E8.4 VL (PDGF) (SEQ ID NO: 2) |
| 90 | PR-1572103H | hBDB-4G8.3 VH (VEGF) (SEQ ID NO: 17) | GS-H10 | hBDI-9E8.4 VH (PDGF) (SEQ ID NO: 1) |
| 91 | PR-1572103L | hBDB-4G8.3 VL (VEGF) (SEQ ID NO: 18) | GS-L11 | hBDI-9E8.4 VL (PDGF) (SEQ ID NO: 2) |
| 92 | PR-1572104H | hBDB-4G8.3 VH (VEGF) (SEQ ID NO: 17) | GS-H10 | hBDI-9E8.4 VH (PDGF) (SEQ ID NO: 1) |
| 93 | PR-1572104L | hBDB-4G8.3 VL (VEGF) (SEQ ID NO: 18) | GS-L10(dR) | hBDI-9E8.4 VL (PDGF) (SEQ ID NO: 2) |
| 94 | PR-1572105H | hBDB-4G8.3 VH (VEGF) (SEQ ID NO: 17) | HG-short | hBDI-9E8.4 VH (PDGF) (SEQ ID NO: 1) |
| 95 | PR-1572105L | hBDB-4G8.3 VL (VEGF) (SEQ ID NO: 18) | LK-long | hBDI-9E8.4 VL (PDGF) (SEQ ID NO: 2) |
| 96 | PR-1572106H | hBDB-4G8.3 VH (VEGF) (SEQ ID NO: 17) | HG-long | hBDI-9E8.4 VH (PDGF) (SEQ ID NO: 1) |
| 97 | PR-1572106L | hBDB-4G8.3 VL (VEGF) (SEQ ID NO: 18) | LK-short | hBDI-9E8.4 VL (PDGF) (SEQ ID NO: 2) |
| 210 | PR-1575573H | hBDI-9E8.4 VH (PDGF) (SEQ ID NO: 1) | HG-long | hBDB-4G8.3 VH (VEGF) (SEQ ID NO: 17) |
| 98 | PR-1575573L | hBDI-9E8.4 VL (PDGF) (SEQ ID NO: 2) | LK-short | hBDB-4G8.3 VL (VEGF) (SEQ ID NO: 18) |
| 99 | PR-1575832H | hBDB-4G8.3 VH (VEGF) (SEQ ID NO: 17) | GS-H10 | hBDI-9E8.4E VH (PDGF) (SEQ ID NO: 11) |
| 100 | PR-1575832L | hBDB-4G8.3 VL (VEGF) (SEQ ID NO: 18) | GS-L10 | hBDI-9E8.4E VL (PDGF) (SEQ ID NO: 12) |
| 101 | PR-1575834H | hBDB-4G8.3 VH (VEGF) (SEQ ID NO: 17) | HG-short | hBDI-9E8.4E VH (PDGF) (SEQ ID NO: 11) |
| 102 | PR-1575834L | hBDB-4G8.3 VL (VEGF) (SEQ ID NO: 18) | LK-long | hBDI-9E8.4E VL (PDGF) (SEQ ID NO: 12) |
| 103 | PR-1575835H | hBDB-4G8.3 VH (VEGF) (SEQ ID NO: 17) | HG-long | hBDI-9E8.4E VH (PDGF) (SEQ ID NO: 11) |
| 104 | PR-1575835L | hBDB-4G8.3 VL (VEGF) (SEQ ID NO: 18) | LK-short | hBDI-9E8.4E VL (PDGF) (SEQ ID NO: 12) |
| 105 | PR-1577165H | hBEW-9A8.12 VH (VEGF) (SEQ ID NO: 25) | GS-H10 | hBDI-9E8.4E VH (PDGF) (SEQ ID NO: 11) |
| 106 | PR-1577165L | hBEW-9A8.12 VL (VEGF) (SEQ ID NO: 26) | GS-L10 | hBDI-9E8.4E VL (PDGF) (SEQ ID NO: 12) |

TABLE 95-continued

Exemplary DVD-Ig Binding Proteins And Component Subunits

| SEQ ID NO | DVD-Ig | Outer VD name | Linker | Inner VD name |
|---|---|---|---|---|
| 107 | PR-1577166H | hBEW-9A8.12 VH (VEGF) (SEQ ID NO: 25) | HG-short | hBDI-9E8.4E VH (PDGF) (SEQ ID NO: 11) |
| 108 | PR-1577166L | hBEW-9A8.12 VL (VEGF) (SEQ ID NO: 26) | LK-long | hBDI-9E8.4E VL (PDGF) (SEQ ID NO: 12) |
| 109 | PR-1577547H | hBEW-9A8.12 VH (VEGF) (SEQ ID NO: 25) | HG-long | hBDI-9E8.4E VH (PDGF) (SEQ ID NO: 11) |
| 110 | PR-1577547L | hBEW-9A8.12 VL (VEGF) (SEQ ID NO: 26) | LK-short | hBDI-9E8.4E VL (PDGF) (SEQ ID NO: 12) |
| 111 | PR-1577548H | hBDI-9E8.4E VH (PDGF) (SEQ ID NO: 11) | HG-short | hBEW-9A8.12 VH (VEGF) (SEQ ID NO: 25) |
| 112 | PR-1577548L | hBDI-9E8.4E VL (PDGF) (SEQ ID NO: 12) | LK-long | hBEW-9A8.12 VL (VEGF) (SEQ ID NO: 26) |
| 113 | PR-1577550H | hBDI-9E8.4E VH (PDGF) (SEQ ID NO: 11) | HG-long | hBEW-9A8.12 VH (VEGF) (SEQ ID NO: 25) |
| 114 | PR-1577550L | hBDI-9E8.4E VL (PDGF) (SEQ ID NO: 12) | LK-short | hBEW-9A8.12 VL (VEGF) (SEQ ID NO: 26) |
| 115 | PR-1578137H | hBDI-9E8.4E VH (PDGF) (SEQ ID NO: 11) | GS-H10 | hBEW-9A8.12 VH (VEGF) (SEQ ID NO: 25) |
| 116 | PR-1578137L | hBDI-9E8.4E VL (PDGF) (SEQ ID NO: 12) | GS-L10 | hBEW-9A8.12 VL (VEGF) (SEQ ID NO: 26) |
| 117 | PR-1598261H | hBDB-4G8.2 VH (VEGF) (SEQ ID NO: 27) | GS-H10 | hBDI-9E8.4 VH (PDGF) (SEQ ID NO: 1) |
| 118 | PR-1598261L | hBDB-4G8.2 VL (VEGF) (SEQ ID NO: 28) | GS-L10 | hBDI-9E8.4 VL (PDGF) (SEQ ID NO: 2) |
| 119 | PR-1598262H | hBDB-4G8.4 VH (VEGF) (SEQ ID NO: 29) | GS-H10 | hBDI-9E8.4 VH (PDGF) (SEQ ID NO: 1) |
| 120 | PR-1598262L | hBDB-4G8.4 VL (VEGF) (SEQ ID NO: 30) | GS-L10 | hBDI-9E8.4 VL (PDGF) (SEQ ID NO: 2) |
| 121 | PR-1598263H | hBDB-4G8.5 VH (VEGF) (SEQ ID NO: 31) | GS-H10 | hBDI-9E8.4 VH (PDGF) (SEQ ID NO: 1) |
| 122 | PR-1598263L | hBDB-4G8.5 VL (VEGF) (SEQ ID NO: 32) | GS-L10 | hBDI-9E8.4 VL (PDGF) (SEQ ID NO: 2) |
| 123 | PR-1598264H | hBDB-4G8.12 VH (VEGF) (SEQ ID NO: 33) | GS-H10 | hBDI-9E8.4 VH (PDGF) (SEQ ID NO: 1) |
| 124 | PR-1598264L | hBDB-4G8.12 VL (VEGF) (SEQ ID NO: 34) | GS-L10 | hBDI-9E8.4 VL (PDGF) (SEQ ID NO: 2) |
| 125 | PR-1598265H | hBDB-4G8.13 VH (VEGF) (SEQ ID NO: 19) | GS-H10 | hBDI-9E8.4 VH (PDGF) (SEQ ID NO: 1) |
| 126 | PR-1598265L | hBDB-4G8.13 VL (VEGF) (SEQ ID NO: 20) | GS-L10 | hBDI-9E8.4 VL (PDGF) (SEQ ID NO: 2) |
| 127 | PR-1598266H | hBDB-4G8.14 VH (VEGF) (SEQ ID NO: 21) | GS-H10 | hBDI-9E8.4 VH (PDGF) (SEQ ID NO: 1) |
| 128 | PR-1598266L | hBDB-4G8.14 VL (VEGF) (SEQ ID NO: 22) | GS-L10 | hBDI-9E8.4 VL (PDGF) (SEQ ID NO: 2) |
| 129 | PR-1610560H | hBDB-4G8.5 VH (VEGF) (SEQ ID NO: 31) | GS-H10 | hBFU-3E2.1 VH (PDGF) (SEQ ID NO: 13) |
| 130 | PR-1610560L | hBDB-4G8.5 VL (VEGF) (SEQ ID NO: 32) | GS-L10(dR) | hBFU-3E2.1 VL (PDGF) (SEQ ID NO: 14) |
| 131 | PR-1610561H | hBEW-9E10.1 VH (VEGF) (SEQ ID NO: 35) | GS-H10 | CL-33675 VH (PDGF) (SEQ ID NO: 15) |
| 132 | PR-1610561L | hBEW-9E10.1 VL (VEGF) (SEQ ID NO: 36) | GS-L10(dR) | CL-33675 VL (PDGF) (SEQ ID NO: 16) |
| 133 | PR-1610562H | hBEW-9E10.1 VH (VEGF) (SEQ ID NO: 35) | GS-H10 | hBFU-3E2.1 VH (PDGF) (SEQ ID NO: 13) |
| 134 | PR-1610562L | hBEW-9E10.1 VL (VEGF) (SEQ ID NO: 36) | GS-L10(dR) | hBFU-3E2.1 VL (PDGF) (SEQ ID NO: 14) |
| 135 | PR-1610563H | hBEW-9E10.6 VH (VEGF) (SEQ ID NO: 37) | GS-H10 | hBFU-3E2.1 VH (PDGF) (SEQ ID NO: 13) |
| 136 | PR-1610563L | hBEW-9E10.6 VL (VEGF) (SEQ ID NO: 38) | GS-L10(dR) | hBFU-3E2.1 VL (PDGF) (SEQ ID NO: 14) |
| 137 | PR-1610564H | hBEW-1B10.1 VH (VEGF) (SEQ ID NO: 39) | GS-H10 | hBFU-3E2.1 VH (PDGF) (SEQ ID NO: 13) |
| 138 | PR-1610564L | hBEW-1B10.1 VL (VEGF) (SEQ ID NO: 40) | GS-L10(dR) | hBFU-3E2.1 VL (PDGF) (SEQ ID NO: 14) |
| 139 | PR-1611291H | hBDB-4G8.5 VH (VEGF) (SEQ ID NO: 31) | GS-H10 | CL-33675 VH (PDGF) (SEQ ID NO: 15) |
| 140 | PR-1611291L | hBDB-4G8.5 VL (VEGF) (SEQ ID NO: 32) | GS-L10(dR) | CL-33675 VL (PDGF) (SEQ ID NO: 16) |
| 141 | PR-1611292H | hBEW-1B10.1 VH (VEGF) (SEQ ID NO: 39) | GS-H10 | CL-33675 VH (PDGF) (SEQ ID NO: 15) |
| 142 | PR-1611292L | hBEW-1B10.1 VL (VEGF) (SEQ ID NO: 40) | GS-L10(dR) | CL-33675 VL (PDGF) (SEQ ID NO: 16) |
| 143 | PR-1611293H | hBEW-1E3.4 VH (VEGF) (SEQ ID NO: 41) | GS-H10 | CL-33675 VH (PDGF) (SEQ ID NO: 15) |

TABLE 95-continued

Exemplary DVD-Ig Binding Proteins And Component Subunits

| SEQ ID NO | DVD-Ig | Outer VD name | Linker | Inner VD name |
|---|---|---|---|---|
| 144 | PR-1611293L | hBEW-1E3.4 VL (VEGF) (SEQ ID NO: 42) | GS-L10(dR) | CL-33675 VL (PDGF) (SEQ ID NO: 16) |
| 145 | PR-1611294H | hBEW-1E3.4 VH (VEGF) (SEQ ID NO: 41) | GS-H10 | hBDI-9E8.4 VH (PDGF) (SEQ ID NO: 1) |
| 146 | PR-1611294L | hBEW-1E3.4 VL (VEGF) (SEQ ID NO: 42) | GS-L10(dR) | hBDI-9E8.4 VL (PDGF) (SEQ ID NO: 2) |
| 147 | PR-1611295H | CL-33675 VH (PDGF) (SEQ ID NO: 15) | GS-H10 | hBEW-9E10.1 VH (VEGF) (SEQ ID NO: 35) |
| 148 | PR-1611295L | CL-33675 VL (PDGF) (SEQ ID NO: 16) | GS-L10(dR) | hBEW-9E10.1 VL (VEGF) (SEQ ID NO: 36) |
| 149 | PR-1611296H | CL-33675 VH (PDGF) (SEQ ID NO: 15) | GS-H10 | hBEW-9E10.6 VH (VEGF) (SEQ ID NO: 37) |
| 150 | PR-1611296L | CL-33675 VL (PDGF) (SEQ ID NO: 16) | GS-L10(dR) | hBEW-9E10.6 VL (VEGF) (SEQ ID NO: 38) |
| 151 | PR-1611297H | CL-33675 VH (PDGF) (SEQ ID NO: 15) | GS-H10 | hBEW-1E3.4 VH (VEGF) (SEQ ID NO: 41) |
| 152 | PR-1611297L | CL-33675 VL (PDGF) (SEQ ID NO: 16) | GS-L10(dR) | hBEW-1E3.4 VL (VEGF) (SEQ ID NO: 42) |
| 153 | PR-1611298H | hBDI-9E8.4 VH (PDGF) (SEQ ID NO: 1) | GS-H10 | hBEW-9E10.1 VH (VEGF) (SEQ ID NO: 35) |
| 154 | PR-1611298L | hBDI-9E8.4 VL (PDGF) (SEQ ID NO: 2) | GS-L10(dR) | hBEW-9E10.1 VL (VEGF) (SEQ ID NO: 36) |
| 155 | PR-1611299H | hBDI-9E8.4 VH (PDGF) (SEQ ID NO: 1) | GS-H10 | hBEW-9E10.6 VH (VEGF) (SEQ ID NO: 37) |
| 156 | PR-1611299L | hBDI-9E8.4 VL (PDGF) (SEQ ID NO: 2) | GS-L10(dR) | hBEW-9E10.6 VL (VEGF) (SEQ ID NO: 38) |
| 157 | PR-1611300H | hBDI-9E8.4 VH (PDGF) (SEQ ID NO: 1) | GS-H10 | hBEW-1B10.1 VH (VEGF) (SEQ ID NO: 39) |
| 158 | PR-1611300L | hBDI-9E8.4 VL (PDGF) (SEQ ID NO: 2) | GS-L10(dR) | hBEW-1B10.1 VL (VEGF) (SEQ ID NO: 40) |
| 159 | PR-1611301H | hBDI-9E8.4 VH (PDGF) (SEQ ID NO: 1) | GS-H10 | hBEW-1E3.4 VH (VEGF) (SEQ ID NO: 41) |
| 160 | PR-1611301L | hBDI-9E8.4 VL (PDGF) (SEQ ID NO: 2) | GS-L10(dR) | hBEW-1E3.4 VH (VEGF) (SEQ ID NO: 42) |
| 161 | PR-1612489H | hBDB-4G8.5 VH (VEGF) (SEQ ID NO: 31) | GS-H10 | hBDI-9E8.4 VH (PDGF) (SEQ ID NO: 1) |
| 162 | PR-1612489L | hBDB-4G8.5 VL (VEGF) (SEQ ID NO: 32) | GS-L10(dR) | hBDI-9E8.4 VL (PDGF) (SEQ ID NO: 2) |
| 163 | PR-1612491H | hBEW-9E10.1 VH (VEGF) (SEQ ID NO: 35) | GS-H10 | hBDI-9E8.4 VH (PDGF) (SEQ ID NO: 1) |
| 164 | PR-1612491L | hBEW-9E10.1 VL (VEGF) (SEQ ID NO: 36) | GS-L10(dR) | hBDI-9E8.4 VL (PDGF) (SEQ ID NO: 2) |
| 165 | PR-1612492H | hBEW-9E10.6 VH (VEGF) (SEQ ID NO: 37) | GS-H10 | CL-33675 VH (PDGF) (SEQ ID NO: 15) |
| 166 | PR-1612492L | hBEW-9E10.6 VL (VEGF) (SEQ ID NO: 38) | GS-L10(dR) | CL-33675 VL (PDGF) (SEQ ID NO: 16) |
| 167 | PR-1612493H | hBEW-9E10.6 VH (VEGF) (SEQ ID NO: 37) | GS-H10 | hBDI-9E8.4 VH (PDGF) (SEQ ID NO: 1) |
| 168 | PR-1612493L | hBEW-9E10.6 VL (VEGF) (SEQ ID NO: 38) | GS-L10(dR) | hBDI-9E8.4 VL (PDGF) (SEQ ID NO: 2) |
| 169 | PR-1612494H | hBEW-1B10.1 VH (VEGF) (SEQ ID NO: 39) | GS-H10 | hBDI-9E8.4 VH (PDGF) (SEQ ID NO: 1) |
| 170 | PR-1612494L | BEW-1B10.1 VL (VEGF) (SEQ ID NO: 40) | GS-L10(dR) | hBDI-9E8.4 VL (PDGF) (SEQ ID NO: 2) |
| 171 | PR-1612495H | hBEW-1E3.4 VH (VEGF) (SEQ ID NO: 41) | GS-H10 | hBFU-3E2.1 VH (PDGF) (SEQ ID NO: 13) |
| 172 | PR-1612495L | hBEW-1E3.4 VL (VEGF) (SEQ ID NO: 42) | GS-L10(dR) | hBFU-3E2.1 VL (PDGF) (SEQ ID NO: 14) |
| 173 | PR-1612496H | CL-33675 VH (PDGF) (SEQ ID NO: 15) | GS-H10 | hBDB-4G8.5 VH (VEGF) (SEQ ID NO: 31) |
| 174 | PR-1612496L | CL-33675 VL (PDGF) (SEQ ID NO: 16) | GS-L10(dR) | hBDB-4G8.5 VL (VEGF) (SEQ ID NO: 32) |
| 175 | PR-1612498H | CL-33675 VH (PDGF) (SEQ ID NO: 15) | GS-H10 | hBEW-1B10.1 VH (VEGF) (SEQ ID NO: 39) |
| 176 | PR-1612498L | CL-33675 VL (PDGF) (SEQ ID NO: 16) | GS-L10(dR) | hBEW-1B10.1 VL (VEGF) (SEQ ID NO: 40) |
| 177 | PR-1612499H | hBFU-3E2.1 VH (PDGF) (SEQ ID NO: 13) | GS-H10 | hBDB-4G8.5 VH (VEGF) (SEQ ID NO: 31) |
| 178 | PR-1612499L | hBFU-3E2.1 VL (PDGF) (SEQ ID NO: 14) | GS-L10(dR) | hBDB-4G8.5 VL (VEGF) (SEQ ID NO: 32) |
| 179 | PR-1612500H | hBFU-3E2.1 VH (PDGF) (SEQ ID NO: 13) | GS-H10 | hBEW-9E10.1 VH (VEGF) (SEQ ID NO: 35) |
| 180 | PR-1612500L | hBFU-3E2.1 VL (PDGF) (SEQ ID NO: 14) | GS-L10(dR) | hBEW-9E10.1 VL (VEGF) (SEQ ID NO: 36) |

TABLE 95-continued

Exemplary DVD-Ig Binding Proteins And Component Subunits

| SEQ ID NO | DVD-Ig | Outer VD name | Linker | Inner VD name |
|---|---|---|---|---|
| 181 | PR-1612501H | hBFU-3E2.1 VH (PDGF) (SEQ ID NO: 13) | GS-H10 | hBEW-9E10.6 VH (VEGF) (SEQ ID NO: 37) |
| 182 | PR-1612501L | hBFU-3E2.1 VL (PDGF) (SEQ ID NO: 14) | GS-L10(dR) | hBEW-9E10.6 VL (VEGF) (SEQ ID NO: 38) |
| 183 | PR-1612502H | hBFU-3E2.1 VH (PDGF) (SEQ ID NO: 13) | GS-H10 | hBEW-1B10.1 VH (VEGF) (SEQ ID NO: 39) |
| 184 | PR-1612502L | hBFU-3E2.1 VL (PDGF) (SEQ ID NO: 14) | GS-L10(dR) | hBEW-1B10.1 VL (VEGF) (SEQ ID NO: 40) |
| 185 | PR-1613183H | CL-34565 VH (VEGF) (SEQ ID NO: 43) | GS-H10 | CL-33675 VH (PDGF) (SEQ ID NO: 15) |
| 186 | PR-1613183L | CL-34565 VL (VEGF) (SEQ ID NO: 44) | GS-L10(dR) | CL-33675 VL (PDGF) (SEQ ID NO: 16) |
| 187 | PR-1613184H | CL-34565 VH (VEGF) (SEQ ID NO: 43) | GS-H10 | hBDI-9E8.4 VH (PDGF) (SEQ ID NO: 1) |
| 188 | PR-1613184L | CL-34565 VL (VEGF) (SEQ ID NO: 44) | GS-L10(dR) | hBDI-9E8.4 VL (PDGF) (SEQ ID NO: 2) |
| 189 | PR-1613185H | CL-34565 VH (VEGF) (SEQ ID NO: 43) | GS-H10 | hBFU-3E2.1 VH (PDGF) (SEQ ID NO: 13) |
| 190 | PR-1613185L | CL-34565 VL (VEGF) (SEQ ID NO: 44) | GS-L10(dR) | hBFU-3E2.1 VL (PDGF) (SEQ ID NO: 14) |
| 191 | PR-1613186H | CL-33675 VH (PDGF) (SEQ ID NO: 15) | GS-H10 | CL-34565 VH (VEGF) (SEQ ID NO: 43) |
| 192 | PR-1613186L | CL-33675 VL (PDGF) (SEQ ID NO: 16) | GS-L10(dR) | CL-34565 VL (VEGF) (SEQ ID NO: 44) |
| 193 | PR-1613187H | hBDI-9E8.4 VH (PDGF) (SEQ ID NO: 1) | GS-H10 | CL-34565 VH (VEGF) (SEQ ID NO: 43) |
| 194 | PR-1613187L | hBDI-9E8.4 VL (PDGF) (SEQ ID NO: 2) | GS-L10(dR) | CL-34565 VL (VEGF) (SEQ ID NO: 44) |
| 195 | PR-1613188H | hBDI-9E8.4 VH (PDGF) (SEQ ID NO: 1) | GS-H10 | hBDB-4G8.5 VH (VEGF) (SEQ ID NO: 31) |
| 196 | PR-1613188L | hBDI-9E8.4 VL (PDGF) (SEQ ID NO: 2) | GS-L10(dR) | hBDB-4G8.5 VL (VEGF) (SEQ ID NO: 32) |
| 197 | PR-1613189H | hBFU-3E2.1 VH (PDGF) (SEQ ID NO: 13) | GS-H10 | CL-34565 VH (VEGF) (SEQ ID NO: 43) |
| 198 | PR-1613189L | hBFU-3E2.1 VL (PDGF) (SEQ ID NO: 14) | GS-L10(dR) | CL-34565 VL (VEGF) (SEQ ID NO: 44) |
| 199 | PR-1613190H | hBFU-3E2.1 VH (PDGF) (SEQ ID NO: 13) | GS-H10 | hBEW-1E3.4 VH (VEGF) (SEQ ID NO: 41) |
| 200 | PR-1613190L | hBFU-3E2.1 VL (PDGF) (SEQ ID NO: 14) | GS-L10(dR) | hBEW-1E3.4 VL (VEGF) (SEQ ID NO: 42) |
| 201 | PR-1629646H | hBEW-9E10.1 VH (VEGF) (SEQ ID NO: 35) | HG-short | CL-33675 VH (PDGF) (SEQ ID NO: 15) |
| 202 | PR-1629646L | hBEW-9E10.1 VL (VEGF) (SEQ ID NO: 36) | LK-long | CL-33675 VL (PDGF) (SEQ ID NO: 16) |
| 203 | PR-1629647H | hBEW-1B10.1 VH (VEGF) (SEQ ID NO: 39) | HG-short | CL-33675 VH (PDGF) (SEQ ID NO: 15) |
| 204 | PR-1629647L | hBEW-1B10.1 VL (VEGF) (SEQ ID NO: 40) | LK-long | CL-33675 VL (PDGF) (SEQ ID NO: 16) |
| 205 | PR-1629648H | hBEW-9E10.1 VH (VEGF) (SEQ ID NO: 35) | HG-long | CL-33675 VH (PDGF) (SEQ ID NO: 15) |
| 206 | PR-1629648L | hBEW-9E10.1 VL (VEGF) (SEQ ID NO: 36) | LK-short | CL-33675 VL (PDGF) (SEQ ID NO: 16) |
| 207 | PR-1629649H | hBEW-1B10.1 VH (VEGF) (SEQ ID NO: 39) | HG-long | CL-33675 VH (PDGF) (SEQ ID NO: 15) |
| 208 | PR-1629649L | hBEW-1B10.1 VL (VEGF) (SEQ ID NO: 40) | LK-short | CL-33675 VL (PDGF) (SEQ ID NO: 16) |

TABLE 96

Sequences of Exemplary DVD-Ig Binding Proteins

| SEQ ID NO | DVD-Ig | Sequence |
|---|---|---|
| 45 | PR-1563988H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSGGGGSGGGGSEVQLVQSGSELKKPGASVKVSCKASGYTFTNYGMY WVRQAPGQGLEWMGWINTETGKPTYADDFKGRFVFSLDTSVSTAYLQISSLKAEDT AVYYCARTNYYRSYIFYFDYWGQGTMVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD |

TABLE 96-continued

Sequences of Exemplary DVD-Ig Binding Proteins

| SEQ ID NO | DVD-Ig | Sequence |
|---|---|---|
| | | WLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCS<br>VMHEALHNHYTQKSLSLSPGK |
| 46 | PR-1563988L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGGGSGGG<br>GSGDTVLTQSPATLSLSPGERATLSCRASESVSTHMHWYQQKPGQAPRLLIYGASNL<br>ESGVPARFSGSGSGTDFTLTISSLEPEDFAVYFCQQSWNDPFTFGQGTKLEIKRTVAA<br>PSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 47 | PR-1563990H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSASTKGPEVQLVQSGSELKKPGASVKVSCKASGYTFTNYGMYWVRQ<br>APGQGLEWMGWINTETGKPTYADDFKGRFVFSLDTSVSTAYLQISSLKAEDTAVYY<br>CARTNYYYRSYIFYFDYWGQGTMVTVSSASTKGPSVFPLAPSSKSTSGGTAALGCLV<br>KDYFPEPVTVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISRTPEVTCV<br>VVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGNVFSCSVMHE<br>ALHNHYTQKSLSLSPGK |
| 48 | PR-1563990L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGTVAAPDT<br>VLTQSPATLSLSPGERATLSCRASESVSTHMHWYQQKPGQAPRLLIYGASNLESGVP<br>ARFSGSGSGTDFTLTISSLEPEDFAVYFCQQSWNDPFTFGQGTKLEIKRTVAAPSVFIF<br>PPSDEQLKSGTASVVCLLNNFYPREAKVQWKVDNALQSGNSQESVTEQDSKDSTYS<br>LSSTLTLSKADYEKHKVYACEVTHQGLSSPVTKSFNRGEC |
| 49 | PR-1563998H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSASTKGPEVQLVQSGSELKKPGASVKVSCKASGYTFTNYGMYWVRQ<br>APGQGLEWMGWINTETGKPTYADDFKGRFVFSLDTSVSTAYLQISSLKAEDTAVYY<br>CARTNYYYRSYIFYFDYWGQGTMVTVSSASTKGPSVFPLAPSSKSTSGGTAALGCLV<br>KDYFPEPVTVSWNSGALTSGVHTFPAVLQSSGLYSLSSVVTVPSSSLGTQTYICNVNH<br>KPSNTKVDKKVEPKSCDKTHTCPPCPAPEAAGGPSVFLFPPKPKDTLMISRTPEVTCV<br>VVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSREEMTKNQVSLTCLVKGFYP<br>SDIAVEWESNGQPENNYKTTPPVLDSDGSFFLYSKLTVDKSRWQQGNVFSCSVMHE<br>ALHNHYTQKSLSLSPGK |
| 50 | PR-1563998L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGTVAAPSV<br>FIFPPDTVLTQSPATLSLSPGERATLSCRASESVSTHMHWYQQKPGQAPRLLIYGASN<br>LESGVPARFSGSGSGTDFTLTISSLEPEDFAVYFCQQSWNDPFTFGQGTKLEIKRTVA<br>APSVFIFPPSDEQLKSGTASVVCLLNNFYPREAKVQWKVDNALQSGNSQESVTEQDS<br>KDSTYSLSSTLTLSKADYEKHKVYACEVTHQGLSSPVTKSFNRGEC |
| 51 | PR-1564009H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSASTKGPSVFPLAPEVQLVQSGSELKKPGASVKVSCKASGYTFTNYG<br>MYWVRQAPGQGLEWMGWINTETGKPTYADDFKGRFVFSLDTSVSTAYLQISSLKAE<br>DTAVYYCARTNYYYRSYIFYFDYWGQGTMVTVSSASTKGPSVFPLAPSSKSTSGGT<br>AALGCLVKDYFPEPVTVSWNSGALTSGVHTFPAVLQSSGLYSLSSVVTVPSSSLGTQ<br>TYICNVNHKPSNTKVDKKVEPKSCDKTHTCPPCPAPEAAGGPSVFLFPPKPKDTLMIS<br>RTPEVTCVVVDVSHEDPEVKFNWYVDGVEVHNAKTKPREEQYNSTYRVVSVLTVL<br>HQDWLNGKEYKCKVSNKALPAPIEKTISKAKGQPREPQVYTLPPSREEMTKNQVSLT<br>CLVKGFYPSDIAVEWESNGQPENNYKTTPPVLDSDGSFFLYSKLTVDKSRWQQGNV<br>FSCSVMHEALHNHYTQKSLSLSPGK |
| 51 | PR-1564009L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGTVAAPDT<br>VLTQSPATLSLSPGERATLSCRASESVSTHMHWYQQKPGQAPRLLIYGASNLESGVP<br>ARFSGSGSGTDFTLTISSLEPEDFAVYFCQQSWNDPFTFGQGTKLEIKRTVAAPSVFIF<br>PPSDEQLKSGTASVVCLLNNFYPREAKVQWKVDNALQSGNSQESVTEQDSKDSTYS<br>LSSTLTLSKADYEKHKVYACEVTHQGLSSPVTKSFNRGEC |
| 53 | PR-1564010H | EVQLVQSGSELKKPGASVKVSCKASGYTFTNYGMYWVRQAPGQGLEWMGWINTE<br>TGKPTYADDFKGRFVFSLDTSVSTAYLQISSLKAEDTAVYYCARTNYYYRSYIFYFD<br>YWGQGTMVTVSSGGGGSGGGGSEVTLRESGPALVKPTQTLTLTCTFSGFSLSTYGM<br>GVGWIRQPPGKALEWLANIWWDDDKYYNPSLKNRLTISKDTSKNQVVLTMTNMDP<br>VDTATYYCARIESIGTTYSFDYWGQGTMVTVSSASTKGPSVFPLAPSSKSTSGGTAAL<br>GCLVKDYFPEPVTVSWNSGALTSGVHTFPAVLQSSGLYSLSSVVTVPSSSLGTQTYIC<br>NVNHKPSNTKVDKKVEPKSCDKTHTCPPCPAPEAAGGPSVFLFPPKPKDTLMISRTPE |

TABLE 96-continued

Sequences of Exemplary DVD-Ig Binding Proteins

| SEQ ID NO | DVD-Ig | Sequence |
|---|---|---|
| | | VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNHYTQKSLSLSPGK |
| 54 | PR-1564010L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRGGSGGGG SGEFVLTQSPGTLSLSPGERATLSCERSSGDIGDSYVSWYQQKPGQAPRLVIYADDQR PSGIPDRFSGSGSGTDFTLTISRLEPEDFAVYYCQSYDINIDIVFGGGTKVEIKGTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 55 | PR-1564011H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESIGTTYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNHYTQKSLSLSPGK |
| 56 | PR-1564011L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPEF VLTQSPGTLSLSPGERATLSCERSSGDIGDSYVSWYQQKPGQAPRLVIYADDQRPSGI PDRFSGSGSGTDFTLTISRLEPEDFAVYYCQSYDINIDIVFGGGTKVEIKGTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 57 | PR-1564012H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESIGTTYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNHYTQKSLSLSPGK |
| 58 | PR-1564012L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPSVF IFPPEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKGTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 59 | PR-1564013H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPSVFPLAPEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESIGTTYSFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNHYTQKSLSLSPGK |
| 60 | PR-1564013L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPEF VLTQSPGTLSLSPGERATLSCERSSGDIGDSYVSWYQQKPGQAPRLVIYADDQRPSGI PDRFSGSGSGTDFTLTISRLEPEDFAVYYCQSYDINIDIVFGGGTKVEIKGTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 61 | PR-1564883H (DVD3896H)a | EVTLRESGPALVKPTQTLTLTCTFSGFSLSTFGMGVGWIRQPPGKALEWLANIWWDD DKYYNPSLKNRLTISKDTSKNQAVLTITNMDPVDTATYYCARISTGISSSYYVMDAWG QGTTVTVSSASTKGPEIQLVQSGTEVKKPGESLKISCKASGYTFTNYGMYWVKQMP GKGLEYMGWINTETGKPTYADDFKGRFTFSLDKSFNTAFLQWSSLKASDTAMYFCA RTNYYYRSYIFYFDYWGQGTMVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP |

TABLE 96-continued

Sequences of Exemplary DVD-Ig Binding Proteins

| SEQ ID NO | DVD-Ig | Sequence |
|---|---|---|
| | | SNTKVDKKVEPKSCDKTHTCPPCPAPEAAGGPSVFLFPPKPKDTLMISRTPEVTCVVV<br>DVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEAL<br>HNHYTQKSLSLSPGK |
| 62 | PR-1564883L (DVD3896L)a | DFVLTQSPDSLAVSLGERATINCERSSGDIGDTYVSWYQQKPGQPPKNVIYGNDQRP<br>SGVPDRFSGSGSGNSATLTISSLQAEDVAVYFCQSYDSDIDIVFGGGTKVEIKGTVAA<br>PSVFIFPPETVLTQSPATLSVSPGERATLSCRASESVSTHMHWYQQKPGQAPRLLIYG<br>ASNLESGVPARFSGSGSGTDFTLTISSLQSEDFAVYFCQQSWNDPFTFGQGTRLEIKRT<br>VAAPSVFIFPPSDEQLKSGTASVVCLLNNFYPREAKVQWKVDNALQSGNSQESVTEQ<br>DSKDSTYSLSSTLTLSKADYEKHKVYACEVTHQGLSSPVTKSFNRGEC |
| 63 | PR-1564893H (DVD3897H)a | EVTLRESGPALVKPTQTLTLTCTFSGFSLSTFGMGVGWIRQPPGKALEWLANIWWDD<br>DKYYNPSLKNRLTISKDTSKNQAVLTITNMDPVDTATYYCARISTGISSYYVMDAWG<br>QGTTVTVSSASTKGPEIQLVQSGGGVVQPGGSLRLSCAASGYTFTNYGMYWVKQAP<br>GKGLEYMGWINTETGKPTYADDFKGRFTFSLDTSKSTAYLQLNSLRAEDTAVYFCA<br>RTNYYYRSYIFYFDYWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYICNVNHKP<br>SNTKVDKKVEPKSCDKTHTCPPCPAPEAAGGPSVFLFPPKPKDTLMISRTPEVTCVVV<br>DVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEAL<br>HNHYTQKSLSLSPGK |
| 64 | PR-1564893L (DVD3897L)a | DFVLTQSPDSLAVSLGERATINCERSSGDIGDTYVSWYQQKPGQPPKNVIYGNDQRP<br>SGVPDRFSGSGSGNSATLTISSLQAEDVAVYFCQSYDSDIDIVFGGGTKVEIKGTVAA<br>PSVFIFPPDTVLTQSPSTLSASPGERATISCRASESVSTHMHWYQQKPGQAPKLLIYGA<br>SNLESGVPSRFSGSRSGTDFTLTISSLQPEDFAVYFCQQSWNDPFTFGQGTKVEIKRTV<br>AAPSVFIFPPSDEQLKSGTASVVCLLNNFYPREAKVQWKVDNALQSGNSQESVTEQD<br>SKDSTYSLSSTLTLSKADYEK |
| 209 | PR-1564896H (DVD3898H)a | EVTLRESGPALVKPTQTLTLTCTFSGFSLSTFGMGVGWIRQPPGKALEWLANIWWDD<br>DKYYNPSLKNRLTISKDTSKNQAVLTITNMDPVDTATYYCARISTGISSYYVMDAWG<br>QGTTVTVSSASTKGPEVQLVESGGGLVQPGGSLRLSCAASGYTFTNYGMYWVKQAP<br>GKGLEYMGWINTETGKPTYADDFKGRFTFSLDTSKSTAYLQMNSLRAEDTAVYFCA<br>RTNYYYRSYIFYFDYWGQGTLVTVSSASTKGPSVFPLAPSSKSTSGGTAALGCLVKD<br>YFPEPVTVSWNSGALTSGVHTFPAVLQSSGLYSLSSVVTVPSSSLGTQTYICNVNHKP<br>SNTKVDKKVEPKSCDKTHTCPPCPAPEAAGGPSVFLFPPKPKDTLMISRTPEVTCVVV<br>DVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEAL<br>HNHYTQKSLSLSPGK |
| 65 | PR-1564896L (DVD3898L)a | DFVLTQSPDSLAVSLGERATINCERSSGDIGDTYVSWYQQKPGQPPKNVIYGNDQRP<br>SGVPDRFSGSGSGNSATLTISSLQAEDVAVYFCQSYDSDIDIVFGGGTKVEIKGTVAA<br>PSVFIFPPDTQLTQSPSSLSASVGDRVTISCRASESVSTHMHWYQQKPGKAPKLLIYG<br>ASNLESGVPSRFSGSGSGTDFTLTISSLQPEDFATYFCQQSWNDPFTFGQGTKVEIKRT<br>VAAPSVFIFPPSDEQLKSGTASVVCLLNNFYPREAKVQWKVDNALQSGNSQESVTEQ<br>DSKDSTYSLSSTLTLSKADYEKHKVYACEVTHQGLSSPVTKSFNRGEC |
| 66 | PR-1564898H (DVD3899H)a | EVQLVESGGGLVQPGGSLRLSCAFSGFSLSTFGMGVGWIRQAPGKGLEWLANIWWD<br>DDKYYNPSLKNRLTISKDTSKNQAYLQINSLRAEDTAVYYCARISTGISSYYVMDAW<br>GQGTLVTVSSASTKGPEIQLVQSGGGVVQPGGSLRLSCAASGYTFTNYGMYWVKQA<br>PGKGLEYMGWINTETGKPTYADDFKGRFTFSLDTSKSTAYLQLNSLRAEDTAVYFC<br>ARTNYYYRSYIFYFDYWGQGTLVTVSSASTKGPSVFPLAPSSKSTSGGTAALGCLVK<br>DYFPEPVTVSWNSGALTSGVHTFPAVLQSSGLYSLSSVVTVPSSSLGTQTYICNVNHK<br>PSNTKVDKKVEPKSCDKTHTCPPCPAPEAAGGPSVFLFPPKPKDTLMISRTPEVTCVV<br>VDVSHEDPEVKFNWYVDGVEVHNAKTKPREEQYNSTYRVVSVLTVLHQDWLNGK<br>EYKCKVSNKALPAPIEKTISKAKGQPREPQVYTLPPSREEMTKNQVSLTCLVKGFYPS<br>DIAVEWESNGQPENNYKTTPPVLDSDGSFFLYSKLTVDKSRWQQGNVFSCSVMHEA<br>LHNHYTQKSLSLSPGK |
| 67 | PR-1564898L (DVD3899L)a | DFQLTQSPSSLSASVGDRVTITCERSSGDIGDTYVSWYQQKPGKAPKNVIYGNDQRP<br>SGVPSRFSGSGSGNSATLTISSLQPEDFATYFCQSYDSDIDIVFGQGTKVEIKGTVAAP<br>SVFIFPPDTVLTQSPSTLSASPGERATISCRASESVSTHMHWYQQKPGQAPKLLIYGAS<br>NLESGVPSRFSGSRSGTDFTLTISSLQPEDFAVYFCQQSWNDPFTFGQGTKVEIKRTV<br>AAPSVFIFPPSDEQLKSGTASVVCLLNNFYPREAKVQWKVDNALQSGNSQESVTEQD<br>SKDSTYSLSSTLTLSKADYEKHKVYACEVTHQGLSSPVTKSFNRGEC |
| 68 | PR-1564899H (DVD3900H)a | EVQLVESGGGLVQPGGSLRLSCAFSGFSLSTFGMGVGWIRQAPGKGLEWLANIWWD<br>DDKYYNPSLKNRLTISKDTSKNQAYLQINSLRAEDTAVYYCARISTGISSYYVMDAW<br>GQGTLVTVSSASTKGPEVQLVESGGGLVQPGGSLRLSCAASGYTFTNYGMYWVKQ<br>APGKGLEYMGWINTETGKPTYADDFKGRFTFSLDTSKSTAYLQMNSLRAEDTAVYF<br>CARTNYYYRSYIFYFDYWGQGTLVTVSSASTKGPSVFPLAPSSKSTSGGTAALGCLV |

TABLE 96-continued

Sequences of Exemplary DVD-Ig Binding Proteins

| SEQ ID NO | DVD-Ig | Sequence |
|---|---|---|
| | | KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKTNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNHYTQKSLSLSPGK |
| 69 | PR-1564899L (DVD3900L)a | DFQLTQSPSSLSASVGDRVTITCERSSGDIGDTYVSWYQQKPGKAPKNVIYGNDQRP SGVPSRFSGSGSGNSATLTISSLQPEDFATYFCQSYDSDIDIVFGQGTKVEIKGTVAAP SVFIFPPDTQLTQSPSSLSASVGDRVTISCRASESVSTHMHWYQQKPGKAPKLLIYGA SNLESGVPSRFSGSGSGTDFTLTISSLQPEDFATYFCQQSWNDPFTFGQGTKVEIKRTV AAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| 70 | PR-1565023H (DVD3901H)a | EVTLRESGPALVKPTQTLTLTCTFSGFSLSTYGMGVGWIRQPPGKALEWLANIWWD DDKYYNPSLKNRLTISKDTSKNQAVLTITNMDPVDTATYYCARIESIGTTYSFDYWG QGTTVTVSSASTKGPEIQLVQSGTEVKKPGESLKISCKASGYTFTNYGMYWVKQMP GKGLEYMGWINTETGKPTYADDFKGRFTFSLDKSFNTAFLQWSSLKASDTAMYFCA RTNYYYRSYIFYFDYWGQGTMVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNHYTQKSLSLSPGK |
| 71 | PR-1565023L (DVD3901L)a | DFVLTQSPDSLAVSLGERATINCERSSGDIGDSYVSWYQQKPGQPPKNVIYADDQRP SGVPDRFSGSGSGNSASLTISSLQAEDVAVYFCQSYDINIDIVFGGGTKVEIKGTVAAP SVFIFPPPETVLTQSPATLSVSPGERATLSCRASESVSTHMHWYQQKPGQAPRLLIYGA SNLESGVPARFSGSGSGTDFTLTISSLQSEDFAVYFCQQSWNDPFTFGQGTRLEIKRTV AAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| 72 | PR-1565029H (DVD3902H)a | EVTLRESGPALVKPTQTLTLTCTFSGFSLSTYGMGVGWIRQPPGKALEWLANIWWD DDKYYNPSLKNRLTISKDTSKNQAVLTITNMDPVDTATYYCARIESIGTTYSFDYWG QGTTVTVSSASTKGPEIQLVQSGGGVVQPGGSLRLSCAASGYTFTNYGMYWVKQAP GKGLEYMGWINTETGKPTYADDFKGRFTFSLDTSKSTAYLQLNSLRAEDTAVYFCA RTNYYYRSYIFYFDYWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNHYTQKSLSLSPGK |
| 73 | PR-1565029L (DVD3902L)a | DFVLTQSPDSLAVSLGERATINCERSSGDIGDSYVSWYQQKPGQPPKNVIYADDQRP SGVPDRFSGSGSGNSASLTISSLQAEDVAVYFCQSYDINIDIVFGGGTKVEIKGTVAAP SVFIFPPPDTVLTQSPSTLSASPGERATISCRASESVSTHMHWYQQKPGQAPKLLIYGAS NLESGVPSRFSGSRSGTDFTLTISSLQPEDFAVYFCQQSWNDPFTFGQGTKVEIKRTV AAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| 74 | PR-1565030H (DVD3903H)a | EVTLRESGPALVKPTQTLTLTCTFSGFSLSTYGMGVGWIRQPPGKALEWLANIWWD DDKYYNPSLKNRLTISKDTSKNQAVLTITNMDPVDTATYYCARIESIGTTYSFDYWG QGTTVTVSSASTKGPEVQLVESGGGLVQPGGSLRLSCAASGYTFTNYGMYWVKQAP GKGLEYMGWINTETGKPTYADDFKGRFTFSLDTSKSTAYLQMNSLRAEDTAVYFCA RTNYYYRSYIFYFDYWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNHYTQKSLSLSPGK |
| 75 | PR-1565030L (DVD3903L)a | DFVLTQSPDSLAVSLGERATINCERSSGDIGDSYVSWYQQKPGQPPKNVIYADDQRP SGVPDRFSGSGSGNSASLTISSLQAEDVAVYFCQSYDINIDIVFGGGTKVEIKGTVAAP SVFIFPPPDTQLTQSPSSLSASVGDRVTISCRASESVSTHMHWYQQKPGKAPKLLIYGA SNLESGVPSRFSGSGSGTDFTLTISSLQPEDFATYFCQQSWNDPFTFGQGTKVEIKRTV AAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| 76 | PR-1565031H (DVD3904H)a | EVQLVESGGGLVQPGGSLRLSCAFSGFSLSTYGMGVGWIRQAPGKGLEWLANIWW DDDKYYNPSLKNRLTISKDTSKNQAYLQINSLRAEDTAVYYCARIESIGTTYSFDYW GQGTLVTVSSASTKGPEIQLVQSGGGVVQPGGSLRLSCAASGYTFTNYGMYWVKQA PGKGLEYMGWINTETGKPTYADDFKGRFTFSLDTSKSTAYLQLNSLRAEDTAVYFC |

TABLE 96-continued

Sequences of Exemplary DVD-Ig Binding Proteins

| SEQ ID NO | DVD-Ig | Sequence |
|---|---|---|
| | | ARTNYYYRSYIFYFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTYICNVNHK PSNTKVDKKVEPKSCDKTHTCPPCPAPEAAGGPSVFLFPPKPKDTLMISRTPEVTCVV VDVSHEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTCLVKGFYPS DIAVEWESNGQPENNYKTTPPVLDSDGSFFLYSKLTVDKSRWQQGNVFSCSVMHEA LHNHYTQKSLSLSPGK |
| 77 | PR-1565031L (DVD3904L)a | DFQLTQSPSSLSASVGDRVTITCERSSGDIGDSYVSWYQQKPGKAPKNVIYADDQRPS GVPSRFSGSGSGNSASLTISSLQPEDFATYFCQSYDINIDIVFGQGTKVEIKGTVAAPSV FIFPPDTVLTQSPSTLSASPGERATISCRASESVSTHMHWYQQKPGQAPKLLIYGASNL ESGVPSRFSGSRSGTDFTLTISSLQPEDFAVYFCQQSWNDPFTFGQGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 78 | PR-1565032H (DVD3905H)a | EVQLVESGGGLVQPGGSLRLSCAFSGFSLSTYGMGVGWIRQAPGKGLEWLANIWW DDDKYYNPSLKNRLTISKDTSKNQAYLQINSLRAEDTAVYYCARIESIGTTYSFDYW GQGTLVTVSSASTKGPEVQLVESGGGLVQPGGSLRLSCAASGYTFTNYGMYWVKQ APGKGLEYMGWINTETGKPTYADDFKGRFTFSLDTSKSTAYLQMNSLRAEDTAVYF CARTNYYYRSYIFYFDYWGQGTLVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNHYTQKSLSLSPGK |
| 79 | PR-1565032L (DVD3905L)a | DFQLTQSPSSLSASVGDRVTITCERSSGDIGDSYVSWYQQKPGKAPKNVIYADDQRPS GVPSRFSGSGSGNSASLTISSLQPEDFATYFCQSYDINIDIVFGQGTKVEIKGTVAAPSV FIFPPDTQLTQSPSSLSASVGDRVTISCRASESVSTHMHWYQQKPGKAPKLLIYGASN LESGVPSRFSGSGSGTDFTLTISSLQPEDFATYFCQQSWNDPFTFGQGTKVEIKRTVA APSVFIFPPSDEQLKSGTASVVCLLNNFYPREAKVQWKVDNALQSGNSQESVTEQDS KDSTYSLSSTLTLSKADYEKHKVYACEVTHQGLSSPVTKSFNRGEC |
| 80 | PR-1565035H (DVD3906H)a | EVTLRESGPALVKPTQTLTLTCTFSGFSLSTFGMGVGWIRQPPGKALEWLANIWWDD DKYYNPSLKNRLTISKDTSKNQAVLTITNMDPVDTATYYCARISTGISSYYVMDAWG QGTTVTVSSASTKGPEVQLVESGGGLVQPGGSLRLSCAASGYTFTNYGMYWVKQAP GKGLEYMGWINTETGKPTYADDFKGRFTFSLDTSKSTAYLQMNSLRAEDTAVYFCA RTNYYYRSYIFYFDYWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNHYTQKSLSLSPGK |
| 81 | PR-1565035L (DVD3906L)a | DFQLTQSPSSLSASVGDRVTITCERSSGDIGDTYVSWYQQKPGKAPKNVIYGNDQRP SGVPSRFSGSGSGNSATLTISSLQPEDFATYFCQSYDSDIDIVFGQGTKVEIKGTVAAP SVFIFPPDTQLTQSPSSLSASVGDRVTISCRASESVSTHMHWYQQKPGQAPKLLIYGA SNLESGVPSRFSGSGSGTDFTLTISSLQPEDFATYFCQQSWNDPFTFGQGTKVEIKRTV AAPSVFIFPPSDEQLKSGTASVVCLLNNFYPREAKVQWKVDNALQSGNSQESVTEQD SKDSTYSLSSTLTLSKADYEKHKVYACEVTHQGLSSPVTKSFNRGEC |
| 82 | PR-1565033H (DVD3907H)a | EVTLRESGPALVKPTQTLTLTCTFSGFSLSTYGMGVGWIRQPPGKALEWLANIWWD DDKYYNPSLKNRLTISKDTSKNQAVLTITNMDPVDTATYYCARIESIGTTYSFDYWG QGTTVTVSSASTKGPEVQLVESGGGLVQPGGSLRLSCAASGYTFTNYGMYWVKQAP GKGLEYMGWINTETGKPTYADDFKGRFTFSLDTSKSTAYLQMNSLRAEDTAVYFCA RTNYYYRSYIFYFDYWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNHYTQKSLSLSPGK |
| 83 | PR-1565033L (DVD3907L)a | DFQLTQSPSSLSASVGDRVTITCERSSGDIGDSYVSWYQQKPGKAPKNVIYADDQRPS GVPSRFSGSGSGNSASLTISSLQPEDFATYFCQSYDINIDIVFGQGTKVEIKGTVAAPSV FIFPPDTVLTQSPSTLSASPGERATISCRASESVSTHMHWYQQKPGQAPKLLIYGASNL ESGVPSRFSGSRSGTDFTLTISSLQPEDFAVYFCQQSWNDPFTFGQGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 84 | PR-1569574H | EVQLVQSGSELKKPGASVKVSCKASGYTFTNYGMYWVRQAPGQGLEWMGWINTE TGKPTYADDFKGRFVFSLDTVSTAYLQISSLKAEDTAVYYCARTNYYYRSYIFYFD YWGQGTMVTVSSGGGGSGGGGSEVTLRESGPALVKPTQTLTLTCTFSGFSLSTYGM |

TABLE 96-continued

Sequences of Exemplary DVD-Ig Binding Proteins

| SEQ ID NO | DVD-Ig | Sequence |
|---|---|---|
| | | GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 85 | PR-1569574L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRGGSGGGG SGEFVLTQSPGTLSLSPGERATLSCERSSGDIGDSYVSWYQQKPGQAPRLVIYADDQR PSGIPDRFSGSGSGTDFTLTISRLEPEDFAVYYCQSYDINIDIVFGGGTKVEIKGTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 86 | PR-1569579H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESIGTTYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNAYTQKSLSLSPGK |
| 87 | PR-1569579L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPSVF IFPPEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKGTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 88 | PR-1572102H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 89 | PR-1572102L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRGGSGGGG SGEFVLTQSPGTLSLSPGERATLSCERSSGDIGDSYVSWYQQKPGQAPRLVIYADDQR PSGIPDRFSGSGSGTDFTLTISRLEPEDFAVYYCQSYDINIDIVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 90 | PR-1572103H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 91 | PR-1572103L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRGGSGGGG SGGEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |

TABLE 96-continued

Sequences of Exemplary DVD-Ig Binding Proteins

| SEQ ID NO | DVD-Ig | Sequence |
|---|---|---|
| 92 | PR-1572104H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYRSYIFYFD YWGQGTMVTVSSGGGGSGGGGSEVTLRESGPALVKPTQTLTLTCTFSGFSLSTYGM GVGVWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 93 | PR-1572104L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKGGSGGGGS GGEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 94 | PR-1572105H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYRSYIFYFD YWGQGTMVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESIGTTYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNAYTQKSLSLSPGK |
| 95 | PR-1572105L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPSVF IFPPEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 96 | PR-1572106H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYRSYIFYFD YWGQGTMVTVSSASTKGPSVFPLAPEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESIGTTYSFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 97 | PR-1572106L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPEF VLTQSPGTLSLSPGERATLSCERSSGDIGDSYVSWYQQKPGQAPRLVIYADDQRPSGI PDRFSGSGSGTDFTLTISRLEPEDFAVYYCQSYDINIDIVFGGGTKVEIKRTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 210 | PR-1575573H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYRSYIFYFD YWGQGTMVTVSSASTKGPSVFPLAPEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESIGTTYSFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 98 | PR-1575573L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPEF VLTQSPGTLSLSPGERATLSCERSSGDIGDSYVSWYQQKPGQAPRLVIYADDQRPSGI |

TABLE 96-continued

Sequences of Exemplary DVD-Ig Binding Proteins

| SEQ ID NO | DVD-Ig | Sequence |
|---|---|---|
| | | PDRFSGSGSGTDFTLTISRLEPEDFAVYYCQSYDINIDIVFGGGTKVEIKGTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 99 | PR-1575832H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 100 | PR-1575832L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRGGSGGGG SGEFVLTQSPGTLSLSPGERATLSCERSSGDIGESYVSWYQQKPGQAPRLVIYADDQR PSGIPDRFSGSGSGTDFTLTISRLEPEDFAVYYCQSYDINIDIVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 101 | PR-1575834H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESIGTTYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNAYTQKSLSLSPGK |
| 102 | PR-1575834L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPSVF IFPPEFVLTQSPGTLSLSPGERATLSCERSSGDIGESYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 103 | PR-1575835H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSASTKGPSVFPLAPEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESIGTTYSFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 104 | PR-1575835L | DTVLTQSPATLSLSPGERATLSCRASESVSTHMHWYQQKPGQAPRLLIYGASNLESG VPARFSGSGSGTDFTLTISSLEPEDFAVYFCQQSWNDPFTFGQGTKLEIKRTVAAPEF VLTQSPGTLSLSPGERATLSCERSSGDIGESYVSWYQQKPGQAPRLVIYADDQRPSGI PDRFSGSGSGTDFTLTISRLEPEDFAVYYCQSYDINIDIVFGGGTKVEIKRTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |
| 105 | PR-1577165H | EVQLVQSGAEVKKPGASVKVSCKASGYTFTNYGMYWVRQAPGQGLEWMGWINTE TGKPIYADDFKGRVTMTTDTSTSTAYMELRSLRSDDTAVYYCARVDYDGSFWFAY WGQGTLVTVSSGGGGSGGGGSEVTLRESGPALVKPTQTLTLTCTFSGFSLSTYGMGV GWIRQPPGKALEWLANIWWDDDKYYNPSLKNRLTISKDTSKNQVVLTMTNMDPVD TATYYCARIESIGTTYSFDYWGQGTMVTVSSASTKGPSVFPLAPSSKSTSGGTAALGC LVKDYFPEPVTVSWNSGALTSGVHTFPAVLQSSGLYSLSSVVTVPSSSLGTQTYICNV NHKPSNTKVDKKVEPKSCDKTHTCPPCPAPEAAGGPSVFLFPPKPKDTLMISRTPEVT CVVVDVSHEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVSLTCLVKG FYPSDIAVEWESNGQPENNYKTTPPVLDSDGSFFLYSKLTVDKSRWQQGNVFSCSV MHEALHNAYTQKSLSLSPGK |

TABLE 96-continued

Sequences of Exemplary DVD-Ig Binding Proteins

| SEQ ID NO | DVD-Ig | Sequence |
|---|---|---|
| 106 | PR-1577165L | DTQLTQSPSSLSASVGDRVTITCRASESVSTVIHWYQQKPGKQPKLLIHGASNLESGV PSRFSGSGSGTDFTLTISSLQPEDFATYFCQQHWNDPPTFGQGTKLEIKRGGSGGGGS GEFVLTQSPGTLSLSPGERATLSCERSSGDIGESYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 107 | PR-1577166H | EVQLVQSGAEVKKPGASVKVSCKASGYTFTNYGMYWVRQAPGQGLEWMGWINTE TGKPIYADDFKGRVTMTTDTSTSTAYMELRSLRSDDTAVYYCARVDYDGSFWFAY WGQGTLVTVSSASTKGPEVTLRESGPALVKPTQTLTLTCTFSGFSLSTYGMGVGWIR QPPGKALEWLANIWWDDDKYYNPSLKNRLTISKDTSKNQVVLTMTNMDPVDTATY YCARIESIGTTYSFDYWGQGTMVTVSSASTKGPSVFPLAPSSKSTSGGTAALGCLVK DYFPEPVTVSWNSGALTSGVHTFPAVLQSSGLYSLSSVVTVPSSSLGTQTYICNVNHK PSNTKVDKKVEPKSCDKTHTCPPCPAPEAAGGPSVFLFPPKPKDTLMISRTPEVTCVV VDVSHEDPEVKFNWYVDGVEVHNAKTKPREEQYNSTYRVVSVLTVLHQDWLNGK EYKCKVSNKALPAPIEKTISKAKGQPREPQVYTLPPSREEMTKNQVSLTCLVKGFYPS DIAVEWESNGQPENNYKTTPPVLDSDGSFFLYSKLTVDKSRWQQGNVFSCSVMHEA LHNAYTQKSLSLSPGK |
| 108 | PR-1577166L | DTQLTQSPSSLSASVGDRVTITCRASESVSTVIHWYQQKPGKQPKLLIHGASNLESGV PSRFSGSGSGTDFTLTISSLQPEDFATYFCQQHWNDPPTFGQGTKLEIKRTVAAPSVFI FPPPEFVLTQSPGTLSLSPGERATLSCERSSGDIGESYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 109 | PR-1577547H | EVQLVQSGAEVKKPGASVKVSCKASGYTFTNYGMYWVRQAPGQGLEWMGWINTE TGKPIYADDFKGRVTMTTDTSTSTAYMELRSLRSDDTAVYYCARVDYDGSFWFAY WGQGTLVTVSSASTKGPSVFPLAPEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 110 | PR-1577547L | DTQLTQSPSSLSASVGDRVTITCRASESVSTVIHWYQQKPGKQPKLLIHGASNLESGV PSRFSGSGSGTDFTLTISSLQPEDFATYFCQQHWNDPPTFGQGTKLEIKRTVAAPEFVL TQSPGTLSLSPGERATLSCERSSGDIGESYVSWYQQKPGQAPRLVIYADDQRPSGIPD RFSGSGSGTDFTLTISRLEPEDFAVYYCQSYDINIDIVFGGGTKVEIKRTVAAPSVFIFP PSDEQLKSGTASVVCLLNNFYPREAKVQWKVDNALQSGNSQESVTEQDSKDSTYSL SSTLTLSKADYEKHKVYACEVTHQGLSSPVTKSFNRGEC |
| 111 | PR-1577548H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSASTKGPEVQLVQSGAEVKKPGASVKVSCKASGYTFTNYGMYWVRQ APGQGLEWMGWINTETGKPIYADDFKGRVTMTTDTSTSTAYMELRSLRSDDTAVYY CARVDYDGSFWFAYWGQGTLVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNAYTQKSLSLSPGK |
| 112 | PR-1577548L | EFVLTQSPGTLSLSPGERATLSCERSSGDIGESYVSWYQQKPGQAPRLVIYADDQRPS GIPDRFSGSGSGTDFTLTISRLEPEDFAVYYCQSYDINIDIVFGGGTKVEIKRTVAAPSV FIFPPDTQLTQSPSSLSASVGDRVTITCRASESVSTVIHWYQQKPGKQPKLLIHGASNL ESGVPSRFSGSGSGTDFTLTISSLQPEDFATYFCQQHWNDPPTFGQGTKLEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 113 | PR-1577550H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSASTKGPSVFPLAPEVQLVQSGAEVKKPGASVKVSCKASGYTFTNYG MYWVRQAPGQGLEWMGWINTETGKPIYADDFKGRVTMTTDTSTSTAYMELRSLRS DDTAVYYCARVDYDGSFWFAYWGQGTLVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD |

TABLE 96-continued

Sequences of Exemplary DVD-Ig Binding Proteins

| SEQ ID NO | DVD-Ig | Sequence |
|---|---|---|
| | | WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 114 | PR-1577550L | EFVLTQSPGTLSLSPGERATLSCERSSGDIGESYVSWYQQKPGQAPRLVIYADDQRPS GIPDRFSGSGSGTDFTLTISRLEPEDFAVYYCQSYDINIDIVFGGGTKVEIKRTVAAPDT QLTQSPSSLSASVGDRVTITCRASESVSTVIHWYQQKPGKQPKLLIHGASNLESGVPS RFSGSGSGTDFTLTISSLQPEDFATYFCQQHWNDPPTFGQGTKLEIKRTVAAPSVFIFP PSDEQLKSGTASVVCLLNNFYPREAKVQWKVDNALQSGNSQESVTEQDSKDSTYSL SSTLTLSKADYEKHKVYACEVTHQGLSSPVTKSFNRGEC |
| 115 | PR-1578137H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSGGGGSGGGGSEVQLVQSGAEVKKPGASVKVSCKASGYTFTNYGMY WVRQAPGQGLEWMGWINTETGKPIYADDFKGRVTMTTDTSTSTAYMELRSLRSDD TAVYYCARVDYDGSFWFAYWGQGTLVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 116 | PR-1578137L | EFVLTQSPGTLSLSPGERATLSCERSSGDIGESYVSWYQQKPGQAPRLVIYADDQRPS GIPDRFSGSGSGTDFTLTISRLEPEDFAVYYCQSYDINIDIVFGGGTKVEIKRGGSGGG GSGDTQLTQSPSSLSASVGDRVTITCRASESVSTVIHWYQQKPGKQPKLLIHGASNLE SGVPSRFSGSGSGTDFTLTISSLQPEDFATYFCQQHWNDPPTFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 117 | PR-1598261H | EVQLVQSGSELKKPGASVKVSCKASGYTFTNYGMYWVRQAPGQGLEWMGWINTE TGKPTYADDFKGRFVFSLDTSVSTAYLQISSLKAEDTAVYYCARTNYYYRSYIFYFD YWGQGTMVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNHYTQKSLSLSPGK |
| 118 | PR-1598261L | ATQLTQSPSLSASVGDRVTITCRASESVSTHMHWYQQKPGKQPKLLIYGASNLESGV PSRFSGSGSGTDFTLTISSLQPEDFATYFCQQSWNDPFTFGQGTKLEIKRGGSGGGGS GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 119 | PR-1598262H | EIQLVQSGSELKKPGASVKVSCKASGYTFTNYGMYWVRQAPGQGLEYMGWINTET GKPTYADDFKGRFVFSLDTSVSTAYLQISSLKAEDTAVYFCARTNYYYRSYIFYFDY WGQGTMVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESIGTTYSFDYWGQGTMVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNHYTQKSLSLSPGK |
| 120 | PR-1598262L | AIQLTQSPSSLSASVGDRVTITCRASESVSTHMHWYQQKPGKAPKLLIYGASNLESGV PSRFSGSGSGTDFTLTISSLQPEDFATYFCQQSWNDPFTFGQGTKLEIKRGGSGGGGS GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 121 | PR-1598263H | EIQLVQSGSELKKPGASVKVSCKASGYTFTNYGMYWVRQAPGQGLEYMGWINTET GKPTYADDFKGRFVFSLDTSVSTAYLQISSLKAEDTAVYFCARTNYYYRSYIFYFDY WGQGTMVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESIGTTYSFDYWGQGTMVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV |

TABLE 96-continued

Sequences of Exemplary DVD-Ig Binding Proteins

| SEQ ID NO | DVD-Ig | Sequence |
|---|---|---|
| | | TCVVVDVSHEDPEVKFNWYVDGVEVHNAKTKPREEQYNSTYRVVSVLTVLHQDW<br>LNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSV<br>MHEALHNHYTQKSLSLSPGK |
| 122 | PR-1598263L | ATQLTQSPSLSASVGDRVTITCRASESVSTHMHWYQQKPGKQPKLLIYGASNLESGV<br>PSRFSGSGSGTDFTLTISSLQPEDFATYFCQQSWNDPFTFGQGTKLEIKRGGSGGGS<br>GEFVLTQSPGTLSLSPGERATLSCERSSGDIGDSYVSWYQQKPGQAPRLVIYADDQRP<br>SGIPDRFSGSGSGTDFTLTISRLEPEDFAVYYCQSYDINIDIVFGGGTKVEIKRTVAAPS<br>VFIFPPSDEQLKSGTASVVCLLNNFYPREAKVQWKVDNALQSGNSQESVTEQDSKDS<br>TYSLSSTLTLSKADYEKHKVYACEVTHQGLSSPVTKSFNRGEC |
| 123 | PR-1598264H | EIQLVQSGAEVKKPGASVKVSCKASGYTFTNYGMYWVRQAPGQGLEYMGWINTET<br>GKPTYADDFKGRFTFTLDTSTSTAYMELRSLRSDDTAVYFCARTNYYYRSYIFYFDY<br>WGQGTMVTVSSGGGGSGGGGSEVTLRESGPALVKPTQTLTLTCTFSGFSLSTYGMG<br>VGWIRQPPGKALEWLANIWWDDDKYYNPSLKNRLTISKDTSKNQVVLTMTNMDPV<br>DTATYYCARIESIGTTYSFDYWGQGTMVTVSSASTKGPSVFPLAPSSKSTSGGTAALG<br>CLVKDYFPEPVTVSWNSGALTSGVHTFPAVLQSSGLYSLSSVVTVPSSSLGTQTYICN<br>VNHKPSNTKVDKKVEPKSCDKTHTCPPCPAPEAAGGPSVFLFPPKPKDTLMISRTPEV<br>TCVVVDVSHEDPEVKFNWYVDGVEVHNAKTKPREEQYNSTYRVVSVLTVLHQDW<br>LNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSV<br>MHEALHNHYTQKSLSLSPGK |
| 124 | PR-1598264L | DTVLTQSPATLSLSPGERATLSCRASESVSTHMHWYQQKPGQAPRLLIYGASNLESG<br>VPARFSGSGSGTDFTLTISSLEPEDFAVYFCQQSWNDPFTFGQGTKLEIKRGGSGGGG<br>SGEFVLTQSPGTLSLSPGERATLSCERSSGDIGDSYVSWYQQKPGQAPRLVIYADDQR<br>PSGIPDRFSGSGSGTDFTLTISRLEPEDFAVYYCQSYDINIDIVFGGGTKVEIKRTVAAP<br>SVFIFPPSDEQLKSGTASVVCLLNNFYPREAKVQWKVDNALQSGNSQESVTEQDSKD<br>STYSLSSTLTLSKADYEKHKVYACEVTHQGLSSPVTKSFNRGEC |
| 125 | PR-1598265H | EIQLVQSGTEVKKPGESLKISCKASGYTFTNYGMYWVKQMPGKGLEYMGWINTETG<br>KPTYADDFKGRFTFSLDKSFNTAFLQWSSLKASDTAMYFCARTNYYYRSYIFYFDY<br>WGQGTMVTVSSGGGGSGGGGSEVTLRESGPALVKPTQTLTLTCTFSGFSLSTYGMG<br>VGWIRQPPGKALEWLANIWWDDDKYYNPSLKNRLTISKDTSKNQVVLTMTNMDPV<br>DTATYYCARIESIGTTYSFDYWGQGTMVTVSSASTKGPSVFPLAPSSKSTSGGTAALG<br>CLVKDYFPEPVTVSWNSGALTSGVHTFPAVLQSSGLYSLSSVVTVPSSSLGTQTYICN<br>VNHKPSNTKVDKKVEPKSCDKTHTCPPCPAPEAAGGPSVFLFPPKPKDTLMISRTPEV<br>TCVVVDVSHEDPEVKFNWYVDGVEVHNAKTKPREEQYNSTYRVVSVLTVLHQDW<br>LNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSV<br>MHEALHNHYTQKSLSLSPGK |
| 126 | PR-1598265L | ETVLTQSPATLSVSPGERATLSCRASESVSTHMHWYQQKPGQAPRLLIYGASNLESG<br>VPARFSGSGSGTDFTLTISSLQSEDFAVYFCQQSWNDPFTFGQGTRLEIKRGGSGGGG<br>SGEFVLTQSPGTLSLSPGERATLSCERSSGDIGDSYVSWYQQKPGQAPRLVIYADDQR<br>PSGIPDRFSGSGSGTDFTLTISRLEPEDFAVYYCQSYDINIDIVFGGGTKVEIKRTVAAP<br>SVFIFPPSDEQLKSGTASVVCLLNNFYPREAKVQWKVDNALQSGNSQESVTEQDSKD<br>STYSLSSTLTLSKADYEKHKVYACEVTHQGLSSPVTKSFNRGEC |
| 127 | PR-1598266H | EIQLVQSGGGVVQPGGSLRLSCAASGYTFTNYGMYWVKQAPGKGLEYMGWINTET<br>GKPTYADDFKGRFTFSLDTSKSTAYLQLNSLRAEDTAVYFCARTNYYYRSYIFYFDY<br>WGQGTLVTVSSGGGGSGGGGSEVTLRESGPALVKPTQTLTLTCTFSGFSLSTYGMGV<br>GWIRQPPGKALEWLANIWWDDDKYYNPSLKNRLTISKDTSKNQVVLTMTNMDPVD<br>TATYYCARIESIGTTYSFDYWGQGTMVTVSSASTKGPSVFPLAPSSKSTSGGTAALGC<br>LVKDYFPEPVTVSWNSGALTSGVHTFPAVLQSSGLYSLSSVVTVPSSSLGTQTYICNV<br>NHKPSNTKVDKKVEPKSCDKTHTCPPCPAPEAAGGPSVFLFPPKPKDTLMISRTPEVT<br>CVVVDVSHEDPEVKFNWYVDGVEVHNAKTKPREEQYNSTYRVVSVLTVLHQDWL<br>NGKEYKCKVSNKALPAPIEKTISKAKGQPREPQVYTLPPSREEMTKNQVSLTCLVKG<br>FYPSDIAVEWESNGQPENNYKTTPPVLDSDGSFFLYSKLTVDKSRWQQGNVFSCSV<br>MHEALHNHYTQKSLSLSPGK |
| 128 | PR-1598266L | DTVLTQSPSTLSASPGERATISCRASESVSTHMHWYQQKPGQAPKLLIYGASNLESGV<br>PSRFSGSRSGTDFTLTISSLQPEDFAVYFCQQSWNDPFTFGQGTKVEIKRGGSGGGGS<br>GEFVLTQSPGTLSLSPGERATLSCERSSGDIGDSYVSWYQQKPGQAPRLVIYADDQRP<br>SGIPDRFSGSGSGTDFTLTISRLEPEDFAVYYCQSYDINIDIVFGGGTKVEIKRTVAAPS<br>VFIFPPSDEQLKSGTASVVCLLNNFYPREAKVQWKVDNALQSGNSQESVTEQDSKDS<br>TYSLSSTLTLSKADYEKHKVYACEVTHQGLSSPVTKSFNRGEC |
| 129 | PR-1610560H | EIQLVQSGSELKKPGASVKVSCKASGYTFTNYGMYWVRQAPGQGLEYMGWINTET<br>GKPTYADDFKGRFVFSLDTSVSTAYLQISSLKAEDTAVYFCARTNYYYRSYIFYFDY<br>WGQGTMVTVSSGGGGSGGGGSEVQLVQSGAEVKKPGSSVKVSCKASGYTFTESYM<br>YWVKQAPGQGLELIGRIDPEDGSTDYVEKFKNKATLTADKSTSTAYMELSSLRSEDT<br>AVYFCARFGARSYFYPMDAWGQGTTVTVSSASTKGPSVFPLAPSSKSTSGGTAALG<br>CLVKDYFPEPVTVSWNSGALTSGVHTFPAVLQSSGLYSLSSVVTVPSSSLGTQTYICN |

TABLE 96-continued

Sequences of Exemplary DVD-Ig Binding Proteins

| SEQ ID NO | DVD-Ig | Sequence |
|---|---|---|
| | | VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 130 | PR-1610560L | ATQLTQSPSLSASVGDRVTITCRASESVSTHMHWYQQKPGKQPKLLIYGASNLESGV PSRFSGSGSGTDFTLTISSLQPEDFATYFCQQSWNDPFTFGQGTKLEIKGGSGGGGSG GETVLTQSPATLSLSPGERATLSCRASESVSTLMHWYQQKPGQQPRLLIYGASNLESG VPARFSGSGSGTDFTLTISSLEPEDFAVYFCQQSWNDPWTFGGGTKVEIKRTVAAPSV FIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| 131 | PR-1610561H | EIQLVQSGSELKKPGASVKVSCKASGYTFTNYGMYWVKQAPGQGLEYMGWIDTET GRPTYADDFKGRFVFSLDTSVSTAYLQISSLKAEDTAVYFCARWSGDTTGIRGPWFA YWGQGTLVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESSGPKYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 132 | PR-1610561L | DIRMTQSPSSLSASVGDRVTIECLASEDIYSDLAWYQQKPGKSPKLLIYNANGLQNGV PSRFSGSGSGTDYSLTISSLQPEDVATYFCQQYNYFPGTFGQGTKLEIKGGSGGGGSG GEIVLTQSPGTLSLSPGERATLSCRASSGSIWYSFVSWYQQKPGQAPRLLIYADDQRA SGIPDRFSGSGSGTDFTLTISRLEPEDFAVYYCQSYGINIDVVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 133 | PR-1610562H | EIQLVQSGSELKKPGASVKVSCKASGYTFTNYGMYWVKQAPGQGLEYMGWIDTET GRPTYADDFKGRFVFSLDTSVSTAYLQISSLKAEDTAVYFCARWSGDTTGIRGPWFA YWGQGTLVTVSSGGGGSGGGGSEVQLVQSGAEVKKPGSSVKVSCKASGYTFTESY MYWVKQAPGQGLELIGRIDPEDGSTDYVEKFKNKATLTADKSTSTAYMELSSLRSE DTAVYFCARFGARSYFYPMDAWGQGTTVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 134 | PR-1610562L | DIRMTQSPSSLSASVGDRVTIECLASEDIYSDLAWYQQKPGKSPKLLIYNANGLQNGV PSRFSGSGSGTDYSLTISSLQPEDVATYFCQQYNYFPGTFGQGTKLEIKGGSGGGGSG GETVLTQSPATLSLSPGERATLSCRASESVSTLMHWYQQKPGQQPRLLIYGASNLESG VPARFSGSGSGTDFTLTISSLEPEDFAVYFCQQSWNDPWTFGGGTKVEIKRTVAAPSV FIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| 135 | PR-1610563H | EVQLVQSGAEVKKPGSSVKVSCKASGYTFTNYGMYWVRQAPGQGLEWMGWIDTE TGRPTYADDFKGRFTFTADKSTSTAYMELSSLRSEDTAVYYCARWSGDTTGIRGPWF AYWGQGTLVTVSSGGGGSGGGGSEVQLVQSGAEVKKPGSSVKVSCKASGYTFTESY MYWVKQAPGQGLELIGRIDPEDGSTDYVEKFKNKATLTADKSTSTAYMELSSLRSE DTAVYFCARFGARSYFYPMDAWGQGTTVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 136 | PR-1610563L | DIRMTQSPSSLSASVGDRVTITCLASEDIYSDLAWYQQKPGKSPKLLIYNANGLQNGV PSRFSGSGSGTDYTLTISSLQPEDVATYFCQQYNYFPGTFGQGTKLEIKGGSGGGGSG GETVLTQSPATLSLSPGERATLSCRASESVSTLMHWYQQKPGQQPRLLIYGASNLESG VPARFSGSGSGTDFTLTISSLEPEDFAVYFCQQSWNDPWTFGGGTKVEIKRTVAAPSV FIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| 137 | PR-1610564H | EVQLVESGGGLVQPGGSLRLSCAASGFSFSKYDMAWFRQAPGKGLEWVASITTSGV GTYYRDSVKGRFTVSRDNAKSTLYLQMNSLRAEDTAVYYCARGYGAMDAWGQGT TVTVSSGGGGSGGGGSEVQLVQSGAEVKKPGSSVKVSCKASGYTFTESYMYWVKQ APGQGLELIGRIDPEDGSTDYVEKFKNKATLTADKSTSTAYMELSSLRSEDTAVYFC ARFGARSYFYPMDAWGQGTTVTVSSASTKGPSVFPLAPSSKSTSGGTAALGCLVKD |

TABLE 96-continued

Sequences of Exemplary DVD-Ig Binding Proteins

| SEQ ID NO | DVD-Ig | Sequence |
|---|---|---|
| | | YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNAYTQKSLSLSPGK |
| 138 | PR-1610564L | DIQMTQSPSSLSASVGDRVTITCKASQDIDDYLSWYQQKPGKSPKLVIYAATRLADG VPSRFSGSGSGTDYTLTISSLQPEDFATYYCLQSSSTPWTFGGGTKVEIKGGSGGGGS GGETVLTQSPATLSLSPGERATLSCRASESVSTLMHWYQQKPGQQPRLLIYGASNLES GVPARFSGSGSGTDFTLTISSLEPEDFAVYFCQQSWNDPWTFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 139 | PR-1611291H | EIQLVQSGSELKKPGASVKVSCKASGYTFTNYGMYWVRQAPGQGLEYMGWINTET GKPTYADDFKGRFVFSLDTSVSTAYLQISSLKAEDTAVYFCARTNYYYRSYIFYFDY WGQGTMVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESSGPKYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 140 | PR-1611291L | ATQLTQSPSLSASVGDRVTITCRASESVSTHMHWYQQKPGKQPKLLIYGASNLESGV PSRFSGSGSGTDFTLTISSLQPEDFATYFCQQSWNDPFTFGQGTKLEIKGGSGGGGS GEIVLTQSPGTLSLSPGERATLSCRASSGSIWYSFVSWYQQKPGQAPRLLIYADDQRA SGIPDRFSGSGSGTDFTLTISRLEPEDFAVYYCQSYGINIDVVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 141 | PR-1611292H | EVQLVESGGGLVQPGGSLRLSCAASGFSFSKYDMAWFRQAPGKGLEWVASITTSGV GTYYRDSVKGRFTVSRDNAKSTLYLQMNSLRAEDTAVYYCARGYGAMDAWGQGT TVTVSSGGGGSGGGGSEVTLRESGPALVKPTQTLTLTCTFSGFSLSTYGMGVGWIRQ PPGKALEWLANIWWDDDKYYNPSLKNRLTISKDTSKNQVVLTMTNMDPVDTATYY CARIESSGPKYSFDYWGQGTMVTVSSASTKGPSVFPLAPSSKSTSGGTAALGCLVKD YFPEPVTVSWNSGALTSGVHTFPAVLQSSGLYSLSSVVTVPSSSLGTQTYICNVNHKP SNTKVDKKVEPKSCDKTHTCPPCPAPEAAGGPSVFLFPPKPKDTLMISRTPEVTCVVV DVSHEDPEVKFNWYVDGVEVHNAKTKPREEQYNSTYRVVSVLTVLHQDWLNGKE YKCKVSNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMHEAL HNAYTQKSLSLSPGK |
| 142 | PR-1611292L | DIQMTQSPSSLSASVGDRVTITCKASQDIDDYLSWYQQKPGKSPKLVIYAATRLADG VPSRFSGSGSGTDYTLTISSLQPEDFATYYCLQSSSTPWTFGGGTKVEIKGGSGGGGS GGEIVLTQSPGTLSLSPGERATLSCRASSGSIWYSFVSWYQQKPGQAPRLLIYADDQR ASGIPDRFSGSGSGTDFTLTISRLEPEDFAVYYCQSYGINIDVVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 143 | PR-1611293H | EIQLVQSGSELKKPGASVKVSCKASGYPFTNSGMYWVKQAPGQGLEYMGWINTEA GKPTYADDFKGRFVFSLDTSVSTAYLQISSLKAEDTAVYFCARWGYISDNSYGWFDY WGQGTLVTVSSGGGGSGGGGSEVTLRESGPALVKPTQTLTLTCTFSGFSLSTYGMGV GWIRQPPGKALEWLANIWWDDDKYYNPSLKNRLTISKDTSKNQVVLTMTNMDPVD TATYYCARIESSGPKYSFDYWGQGTMVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 144 | PR-1611293L | ATQLTQSPSSLSASVGDRVTISCRASEGVYSYMHWYQQKPGKQPKLLIYKASNLASG VPSRFSGSGSGTDFTLTISSLQPEDFATYFCHQNWNDPLTFGQGTKLEIKGGSGGGGS GGEIVLTQSPGTLSLSPGERATLSCRASSGSIWYSFVSWYQQKPGQAPRLLIYADDQR ASGIPDRFSGSGSGTDFTLTISRLEPEDFAVYYCQSYGINIDVVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 145 | PR-1611294H | EIQLVQSGSELKKPGASVKVSCKASGYPFTNSGMYWVKQAPGQGLEYMGWINTEA GKPTYADDFKGRFVFSLDTSVSTAYLQISSLKAEDTAVYFCARWGYISDNSYGWFDY WGQGTLVTVSSGGGGSGGGGSEVTLRESGPALVKPTQTLTLTCTFSGFSLSTYGMGV GWIRQPPGKALEWLANIWWDDDKYYNPSLKNRLTISKDTSKNQVVLTMTNMDPVD |

TABLE 96-continued

Sequences of Exemplary DVD-Ig Binding Proteins

| SEQ ID NO | DVD-Ig | Sequence |
|---|---|---|
| | | TATYYCARIESIGTTYSFDYWGQGTMVTVSSASTKGPSVFPLAPSSKSTSGGTAALGC LVKDYFPEPVTVSWNSGALTSGVHTFPAVLQSSGLYSLSSVVTVPSSSLGTQTYICNV NHKPSNTKVDKKVEPKSCDKTHTCPPCPAPEAAGGPSVFLFPPKPKDTLMISRTPEVT CVVVDVSHEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVSLTCLVKG FYPSDIAVEWESNGQPENNYKTTPPVLDSDGSFFLYSKLTVDKSRWQQGNVFSCSV MHEALHNAYTQKSLSLSPGK |
| 146 | PR-1611294L | ATQLTQSPSSLSASVGDRVTISCRASEGVYSYMHWYQQKPGKQPKLLIYKASNLASG VPSRFSGSGSGTDFTLTISSLQPEDFATYFCHQNWNDPLTFGQGTKLEIKGGSGGGGS GGEFVLTQSPGTLSLSPGERATLSCERSSGDIGDSYVSWYQQKPGQAPRLVIYADDQ RPSGIPDRFSGSGSGTDFTLTISRLEPEDFAVYYCQSYDINIDIVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 147 | PR-1611295H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESSGPKYSFDYW GQGTMVTVSSGGGGSGGGGSEIQLVQSGSELKKPGASVKVSCKASGYTFTNYGMY WVKQAPGQGLEYMGWIDTETGRPTYADDFKGRFVFSLDTSVSTAYLQISSLKAEDT AVYFCARWSGDTTGIRGPWFAYWGQGTLVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 148 | PR-1611295L | EIVLTQSPGTLSLSPGERATLSCRASSGSIWYSFVSWYQQKPGQAPRLLIYADDQRAS GIPDRFSGSGSGTDFTLTISRLEPEDFAVYYCQSYGINIDVVFGGGTKVEIKGGSGGGG SGGDIRMTQSPSSLSASVGDRVTIECLASEDIYSDLAWYQQKPGKSPKLLIYNANGLQ NGVPSRFSGSGSGTDYSLTISSLQPEDVATYFCQQYNYFPGTFGQGTKLEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 149 | PR-1611296H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESSGPKYSFDYW GQGTMVTVSSGGGGSGGGGSEVQLVQSGAEVKKPGSSVKVSCKASGYTFTNYGMY WVRQAPGQGLEWMGWIDTETGRPTYADDFKGRFTFTADKSTSTAYMELSSLRSEDT AVYYCARWSGDTTGIRGPWFAYWGQGTLVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 150 | PR-1611296L | EIVLTQSPGTLSLSPGERATLSCRASSGSIWYSFVSWYQQKPGQAPRLLIYADDQRAS GIPDRFSGSGSGTDFTLTISRLEPEDFAVYYCQSYGINIDVVFGGGTKVEIKGGSGGGG SGGDIRMTQSPSSLSASVGDRVTITCLASEDIYSDLAWYQQKPGKSPKLLIYNANGLQ NGVPSRFSGSGSGTDYLTISSLQPEDVATYFCQQYNYFPGTFGQGTKLEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 151 | PR-1611297H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESSGPKYSFDYW GQGTMVTVSSGGGGSGGGGSEIQLVQSGSELKKPGASVKVSCKASGYPFTNSGMY WVKQAPGQGLEYMGWINTEAGKPTYADDFKGRFVFSLDTSVSTAYLQISSLKAEDT AVYFCARWGYISDNSYGWFDYWGQGTLVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 152 | PR-1611297L | EIVLTQSPGTLSLSPGERATLSCRASSGSIWYSFVSWYQQKPGQAPRLLIYADDQRAS GIPDRFSGSGSGTDFTLTISRLEPEDFAVYYCQSYGINIDVVFGGGTKVEIKGGSGGGG SGGATQLTQSPSSLSASVGDRVTISCRASEGVYSYMHWYQQKPGKQPKLLIYKASNL ASGVPSRFSGSGSGTDFTLTISSLQPEDFATYFCHQNWNDPLTFGQGTKLEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 153 | PR-1611298H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSGGGGSGGGGSEIQLVQSGSELKKPGASVKVSCKASGYTFTNYGMY |

TABLE 96-continued

Sequences of Exemplary DVD-Ig Binding Proteins

| SEQ ID NO | DVD-Ig | Sequence |
|---|---|---|
| | | WVKQAPGQGLEYMGWIDTETGRPTYADDFKGRFVFSLDTSVSTAYLQISSLKAEDT<br>AVYFCARWSGDTTGIRGPWFAYWGQGTLVTVSSASTKGPSVFPLAPSSKSTSGGTA<br>ALGCLVKDYFPEPVTVSWNSGALTSGVHTFPAVLQSSGLYSLSSVVTVPSSSLGTQT<br>YICNVNHKPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSREEMTKNQVSLTC<br>LVKGFYPSDIAVEWESNGQPENNYKTTPPVLDSDGSFFLYSKLTVDKSRWQQGNVFS<br>CSVMHEALHNAYTQKSLSLSPGK |
| 154 | PR-1611298L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGGSGGGG<br>SGGDIRMTQSPSSLSASVGDRVTIECLASEDIYSDLAWYQQKPGKSPKLLIYNANGLQ<br>NGVPSRFSGSGSGTDYSLTISSLQPEDVATYFCQQYNYFPGTFGQGTKLEIKRTVAAP<br>SVFIFPPSDEQLKSGTASVVCLLNNFYPREAKVQWKVDNALQSGNSQESVTEQDSKD<br>STYSLSSTLTLSKADYEKHKVYACEVTHQGLSSPVTKSFNRGEC |
| 155 | PR-1611299H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSGGGGSGGGGSEVQLVQSGAEVKKPGSSVKVSCKASGYTFTNYGMY<br>WVRQAPGQGLEWMGWIDTETGRPTYADDFKGRFTFTADKSTSTAYMELSSLRSEDT<br>AVYYCARWSGDTTGIRGPWFAYWGQGTLVTVSSASTKGPSVFPLAPSSKSTSGGTA<br>ALGCLVKDYFPEPVTVSWNSGALTSGVHTFPAVLQSSGLYSLSSVVTVPSSSLGTQT<br>YICNVNHKPSNTKVDKKVEPKSCDKTHTCPPCPAPEAAGGPSVFLFPPKPKDTLMISR<br>TPEVTCVVVDVSHEDPEVKFNWYVDGVEVHNAKTKPREEQYNSTYRVVSVLTVLH<br>QDWLNGKEYKCKVSNKALPAPIEKTISKAKGQPREPQVYTLPPSREEMTKNQVSLTC<br>LVKGFYPSDIAVEWESNGQPENNYKTTPPVLDSDGSFFLYSKLTVDKSRWQQGNVFS<br>CSVMHEALHNAYTQKSLSLSPGK |
| 156 | PR-1611299L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGGSGGGG<br>SGGDIRMTQSPSSLSASVGDRVTITCLASEDIYSDLAWYQQKPGKSPKLLIYNANGLQ<br>NGVPSRFSGSGSGTDYTLTISSLQPEDVATYFCQQYNYFPGTFGQGTKLEIKRTVAAP<br>SVFIFPPSDEQLKSGTASVVCLLNNFYPREAKVQWKVDNALQSGNSQESVTEQDSKD<br>STYSLSSTLTLSKADYEKHKVYACEVTHQGLSSPVTKSFNRGEC |
| 157 | PR-1611300H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSGGGGSGGGGSEVQLVESGGGLVQPGGSLRLSCAASGFSFSKYDMA<br>WFRQAPGKGLEWVASITTSGVGTYYRDSVKGRFTVSRDNAKSTLYLQMNSLRAEDT<br>AVYYCARGYGAMDAWGQGTTVTVSSASTKGPSVFPLAPSSKSTSGGTAALGCLVK<br>DYFPEPVTVSWNSGALTSGVHTFPAVLQSSGLYSLSSVVTVPSSSLGTQTYICNVNHK<br>PSNTKVDKKVEPKSCDKTHTCPPCPAPEAAGGPSVFLFPPKPKDTLMISRTPEVTCVV<br>VDVSHEDPEVKFNWYVDGVEVHNAKTKPREEQYNSTYRVVSVLTVLHQDWLNGK<br>EYKCKVSNKALPAPIEKTISKAKGQPREPQVYTLPPSREEMTKNQVSLTCLVKGFYPS<br>DIAVEWESNGQPENNYKTTPPVLDSDGSFFLYSKLTVDKSRWQQGNVFSCSVMHEA<br>LHNAYTQKSLSLSPGK |
| 158 | PR-1611300L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGGSGGGG<br>SGGDIQMTQSPSSLSASVGDRVTITCKASQDIDDYLSWYQQKPGKSPKLVIYAATRL<br>ADGVPSRFSGSGSGTDYTLTISSLQPEDFATYYCLQSSSTPWTFGGGTKVEIKRTVAA<br>PSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 159 | PR-1611301H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESIGTTYSFDYW<br>GQGTMVTVSSGGGGSGGGGSEIQLVQSGSELKKPGASVKVSCKASGYPFTNSGMY<br>WVKQAPGQGLEYMGWINTEAGKPTYADDFKGRFVFSLDTSVSTAYLQISSLKAEDT<br>AVYFCARWGYISDNSYGWFDYWGQGTLVTVSSASTKGPSVFPLAPSSKSTSGGTAA<br>LGCLVKDYFPEPVTVSWNSGALTSGVHTFPAVLQSSGLYSLSSVVTVPSSSLGTQTYI<br>CNVNHKPSNTKVDKKVEPKSCDKTHTCPPCPAPEAAGGPSVFLFPPKPKDTLMISRTP<br>EVTCVVVDVSHEDPEVKFNWYVDGVEVHNAKTKPREEQYNSTYRVVSVLTVLHQD<br>WLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCS<br>VMHEALHNAYTQKSLSLSPGK |
| 160 | PR-1611301L | EFVLTQSPGTLSLSPGERATLSCERSSGDIGDSYVSWYQQKPGQAPRLVIYADDQRPS<br>GIPDRFSGSGSGTDFTLTISRLEPEDFAVYYCQSYDINIDIVFGGGTKVEIKGGSGGGG<br>SGGATQLTQSPSSLSASVGDRVTISCRASEGVYSYMHWYQQKPGKQPKLLIYKASNL<br>ASGVPSRFSGSGSGTDFTLTISSLQPEDFATYFCHQNWNDPLTFGQGTKLEIKRTVAA<br>PSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |

TABLE 96-continued

Sequences of Exemplary DVD-Ig Binding Proteins

| SEQ ID NO | DVD-Ig | Sequence |
|---|---|---|
| 161 | PR-1612489H | EIQLVQSGSELKKPGASVKVSCKASGYTFTNYGMYWVRQAPGQGLEYMGWINTET GKPTYADDFKGRFVFSLDTSVSTAYLQISSLKAEDTAVYFCARTNYYYRSYIFYDY WGQGTMVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESIGTTYSFDYWGQGTMVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 162 | PR-1612489L | ATQLTQSPSLSASVGDRVTITCRASESVSTHMHWYQQKPGKQPKLLIYGASNLESGV PSRFSGSGSGTDFTLTISSLQPEDFATYFCQQSWNDPFTFGQGTKLEIKGGSGGGGSG GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 163 | PR-1612491H | EIQLVQSGSELKKPGASVKVSCKASGYTFTNYGMYWVKQAPGQGLEYMGWIDTET GRPTYADDFKGRFVFSLDTSVSTAYLQISSLKAEDTAVYFCARWSGDTTGIRGPWFA YWGQGTLVTVSSGGGGSGGGGSEVTLRESGPALVKPTQTLTLTCTFSGFSLSTYGMG VGWIRQPPGKALEWLANIWWDDDKYYNPSLKNRLTISKDTSKNQVVLTMTNMDPV DTATYYCARIESIGTTYSFDYWGQGTMVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 164 | PR-1612491L | DIRMTQSPSSLSASVGDRVTIECLASEDIYSDLAWYQQKPGKSPKLLIYNANGLQNGV PSRFSGSGSGTDYSLTISSLQPEDVATYFCQQYNYFPGTFGQGTKLEIKGGSGGGGSG GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 165 | PR-1612492H | EVQLVQSGAEVKKPGSSVKVSCKASGYTFTNYGMYWVRQAPGQGLEWMGWIDTE TGRPTYADDFKGRFTFTADKSTSTAYMELSSLRSEDTAVYYCARWSGDTTGIRGPWF AYWGQGTLVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESSGPKYSFDYWGQGTMVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 166 | PR-1612492L | DIRMTQSPSSLSASVGDRVTITCLASEDIYSDLAWYQQKPGKSPKLLIYNANGLQNGV PSRFSGSGSGTDYTLTISSLQPEDVATYFCQQYNYFPGTFGQGTKLEIKGGSGGGGSG GEIVLTQSPGTLSLSPGERATLSCRASSGSIWYSFVSWYQQKPGQAPRLLIYADDQRA SGIPDRFSGSGSGTDFTLTISRLEPEDFAVYYCQSYGINIDVVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 167 | PR-1612493H | EVQLVQSGAEVKKPGSSVKVSCKASGYTFTNYGMYWVRQAPGQGLEWMGWIDTE TGRPTYADDFKGRFTFTADKSTSTAYMELSSLRSEDTAVYYCARWSGDTTGIRGPWF AYWGQGTLVTVSSGGGGSGGGGSEVTLRESGPALVKPTQTLTLTCTFSGFSLSTYGM GVGWIRQPPGKALEWLANIWWDDDKYYNPSLKNRLTISKDTSKNQVVLTMTNMDP VDTATYYCARIESIGTTYSFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 168 | PR-1612493L | DIRMTQSPSSLSASVGDRVTITCLASEDIYSDLAWYQQKPGKSPKLLIYNANGLQNGV PSRFSGSGSGTDYTLTISSLQPEDVATYFCQQYNYFPGTFGQGTKLEIKGGSGGGGSG GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS |

TABLE 96-continued

Sequences of Exemplary DVD-Ig Binding Proteins

| SEQ ID NO | DVD-Ig | Sequence |
|---|---|---|
| | | VFIFPPSDEQLKSGTASVVCLLNNFYPREAKVQWKVDNALQSGNSQESVTEQDSKDS<br>TYSLSSTLTLSKADYEKHKVYACEVTHQGLSSPVTKSFNRGEC |
| 169 | PR-1612494H | EVQLVESGGGLVQPGGSLRLSCAASGFSFSKYDMAWFRQAPGKGLEWVASITTSGV<br>GTYYRDSVKGRFTVSRDNAKSTLYLQMNSLRAEDTAVYYCARGYGAMDAWGQGT<br>TVTVSSGGGGSGGGGSEVTLRESGPALVKPTQTLTLTCTFSGFSLSTYGMGVGWIRQ<br>PPGKALEWLANIWWDDDKYYNPSLKNRLTISKDTSKNQVVLTMTNMDPVDTATYY<br>CARIESIGTTYSFDYWGQGTMVTVSSASTKGPSVFPLAPSSKSTSGGTAALGCLVKD<br>YFPEPVTVSWNSGALTSGVHTFPAVLQSSGLYSLSSVVTVPSSSLGTQTYICNVNHKP<br>SNTKVDKKVEPKSCDKTHTCPPCPAPEAAGGPSVFLFPPKPKDTLMISRTPEVTCVVV<br>DVSHEDPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLTCLVKGFYPSD<br>IAVEWESNGQPENNYKTTPPVLDSDGSFFLYSKLTVDKSRWQQGNVFSCSVMHEAL<br>HNAYTQKSLSLSPGK |
| 170 | PR-1612494L | DIQMTQSPSSLSASVGDRVTITCKASQDIDDYLSWYQQKPGKSPKLVIYAATRLADG<br>VPSRFSGSGSGTDYTLTISSLQPEDFATYYCLQSSSTPWTFGGGTKVEIKGGSGGGGS<br>GGEFVLTQSPGTLSLSPGERATLSCERSSGDIGDSYVSWYQQKPGQAPRLVIYADDQ<br>RPSGIPDRFSGSGSGTDFTLTISRLEPEDFAVYYCQSYDINIDIVFGGGTKVEIKRTVAA<br>PSVFIFPPSDEQLKSGTASVVCLLNNFYPREAKVQWKVDNALQSGNSQESVTEQDSK<br>DSTYSLSSTLTLSKADYEKHKVYACEVTHQGLSSPVTKSFNRGEC |
| 171 | PR-1612495H | EIQLVQSGSELKKPGASVKVSCKASGYPFTNSGMYWVKQAPGQGLEYMGWINTEA<br>GKPTYADDFKGRFVFSLDTSVSTAYLQISSLKAEDTAVYFCARWGYISDNSYGWFDY<br>WGQGTLVTVSSGGGGSGGGGSEVQLVQSGAEVKKPGSSVKVSCKASGYTFTESYM<br>YWVKQAPGQGLELIGRIDPEDGSTDYVEKFKNKATLTADKSTSTAYMELSSLRSEDT<br>AVYFCARFGARSYFYPMDAWGQGTTVTVSSASTKGPSVFPLAPSSKSTSGGTAALG<br>CLVKDYFPEPVTVSWNSGALTSGVHTFPAVLQSSGLYSLSSVVTVPSSSLGTQTYICN<br>VNHKPSNTKVDKKVEPKSCDKTHTCPPCPAPEAAGGPSVFLFPPKPKDTLMISRTPEV<br>TCVVVDVSHEDPEVKFNWYVDGVEVHNAKTKPREEQYNSTYRVVSVLTVLHQDW<br>LNGKEYKCKVSNKALPAPIEKTISKAKGQPREPQVYTLPPSREEMTKNQVSLTCLVK<br>GFYPSDIAVEWESNGQPENNYKTTPPVLDSDGSFFLYSKLTVDKSRWQQGNVFSCSV<br>MHEALHNAYTQKSLSLSPGK |
| 172 | PR-1612495L | ATQLTQSPSSLSASVGDRVTISCRASEGVYSYMHWYQQKPGKQPKLLIYKASNLASG<br>VPSRFSGSGSGTDFTLTISSLQPEDFATYFCHQNWNDPLTFGQGTKLEIKGGSGGGGS<br>GGETVLTQSPATLSLSPGERATLSCRASESVSTLMHWYQQKPGQQPRLLIYGASNLES<br>GVPARFSGSGSGTDFTLTISSLEPEDFAVYFCQQSWNDPWTFGGGTKVEIKRTVAAPS<br>VFIFPPSDEQLKSGTASVVCLLNNFYPREAKVQWKVDNALQSGNSQESVTEQDSKDS<br>TYSLSSTLTLSKADYEKHKVYACEVTHQGLSSPVTKSFNRGEC |
| 173 | PR-1612496H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESSGPKYSFDYW<br>GQGTMVTVSSGGGGSGGGGSEIQLVQSGSELKKPGASVKVSCKASGYTFTNYGMY<br>WVRQAPGQGLEYMGWINTETGKPTYADDFKGRFVFSLDTSVSTAYLQISSLKAEDT<br>AVYFCARTNYYYRSYIFYFDYWGQGTMVTVSSASTKGPSVFPLAPSSKSTSGGTAAL<br>GCLVKDYFPEPVTVSWNSGALTSGVHTFPAVLQSSGLYSLSSVVTVPSSSLGTQTYIC<br>NVNHKPSNTKVDKKVEPKSCDKTHTCPPCPAPEAAGGPSVFLFPPKPKDTLMISRTPE<br>VTCVVVDVSHEDPEVKFNWYVDGVEVHNAKTKPREEQYNSTYRVVSVLTVLHQD<br>WLNGKEYKCKVSNKALPAPIEKTISKAKGQPREPQVYTLPPSREEMTKNQVSLTCLV<br>KGFYPSDIAVEWESNGQPENNYKTTPPVLDSDGSFFLYSKLTVDKSRWQQGNVFSCS<br>VMHEALHNAYTQKSLSLSPGK |
| 174 | PR-1612496L | EIVLTQSPGTLSLSPGERATLSCRASSGSIWYSFVSWYQQKPGQAPRLLIYADDQRAS<br>GIPDRFSGSGSGTDFTLTISRLEPEDFAVYYCQSYGINIDVVFGGGTKVEIKGGSGGGG<br>SGGATQLTQSPSSLSASVGDRVTITCRASESVSTHMHWYQQKPGKQPKLLIYGASNLE<br>SGVPSRFSGSGSGTDFTLTISSLQPEDFATYFCQQSWNDPFTFGQGTKLEIKRTVAAPS<br>VFIFPPSDEQLKSGTASVVCLLNNFYPREAKVQWKVDNALQSGNSQESVTEQDSKDS<br>TYSLSSTLTLSKADYEKHKVYACEVTHQGLSSPVTKSFNRGEC |
| 175 | PR-1612498H | EVTLRESGPALVKPTQTLTLTCTFSGFSLSTYGMGVGWIRQPPGKALEWLANIWWD<br>DDKYYNPSLKNRLTISKDTSKNQVVLTMTNMDPVDTATYYCARIESSGPKYSFDYW<br>GQGTMVTVSSGGGGSGGGGSEVQLVESGGGLVQPGGSLRLSCAASGFSFSKYDMA<br>WFRQAPGKGLEWVASITTSGVGTYYRDSVKGRFTVSRDNAKSTLYLQMNSLRAEDT<br>AVYYCARGYGAMDAWGQGTTVTVSSASTKGPSVFPLAPSSKSTSGGTAALGCLVK<br>DYFPEPVTVSWNSGALTSGVHTFPAVLQSSGLYSLSSVVTVPSSSLGTQTYICNVNHK<br>PSNTKVDKKVEPKSCDKTHTCPPCPAPEAAGGPSVFLFPPKPKDTLMISRTPEVTCVV<br>VDVSHEDPEVKFNWYVDGVEVHNAKTKPREEQYNSTYRVVSVLTVLHQDWLNGK<br>EYKCKVSNKALPAPIEKTISKAKGQPREPQVYTLPPSREEMTKNQVSLTCLVKGFYPS<br>DIAVEWESNGQPENNYKTTPPVLDSDGSFFLYSKLTVDKSRWQQGNVFSCSVMHEA<br>LHNAYTQKSLSLSPGK |
| 176 | PR-1612498L | EIVLTQSPGTLSLSPGERATLSCRASSGSIWYSFVSWYQQKPGQAPRLLIYADDQRAS<br>GIPDRFSGSGSGTDFTLTISRLEPEDFAVYYCQSYGINIDVVFGGGTKVEIKGGSGGGG<br>SGGDIQMTQSPSSLSASVGDRVTITCKASQDIDDYLSWYQQKPGKSPKLVIYAATRL |

TABLE 96-continued

Sequences of Exemplary DVD-Ig Binding Proteins

| SEQ ID NO | DVD-Ig | Sequence |
|---|---|---|
| | | ADGVPSRFSGSGSGTDYTLTISSLQPEDFATYYCLQSSSTPWTFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 177 | PR-1612499H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEIQLVQSGSELKKPGASVKVSCKASGYTFTNYGMYWV RQAPGQGLEYMGWINTETGKPTYADDFKGRFVFSLDTSVSTAYLQISSLKAEDTAVY FCARTNYYYRSYIFYFDYWGQGTMVTVSSASTKGPSVFPLAPSSKSTSGGTAALGCL VKDYFPEPVTVSWNSGALTSGVHTFPAVLQSSGLYSLSSVVTVPSSSLGTQTYICNVN HKPSNTKVDKKVEPKSCDKTHTCPPCPAPEAAGGPSVFLFPPKPKDTLMISRTPEVTC VVVDVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVFSCSVM HEALHNAYTQKSLSLSPGK |
| 178 | PR-1612499L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGGS GGATQLTQSPSLSASVGDRVTITCRASESVSTHMHWYQQKPGKQPKLLIYGASNLES GVPSRFSGSGSGTDFTLTISSLQPEDFATYFCQQSWNDPFTFGQGTKLEIKRTVAAPSV FIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| 179 | PR-1612500H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEIQLVQSGSELKKPGASVKVSCKASGYTFTNYGMYWV KQAPGQGLEYMGWIDTETGRPTYADDFKGRFVFSLDTSVSTAYLQISSLKAEDTAVY FCARWSGDTTGIRGPWFAYWGQGTLVTVSSASTKGPSVFPLAPSSKSTSGGTAALGC LVKDYFPEPVTVSWNSGALTSGVHTFPAVLQSSGLYSLSSVVTVPSSSLGTQTYICNV NHKPSNTKVDKKVEPKSCDKTHTCPPCPAPEAAGGPSVFLFPPKPKDTLMISRTPEVT CVVVDVSHEDPEVKFNWYVDGVEVHNAKTKPREEQYNSTYRVVSVLTVLHQDWL NGKEYKCKVSNKALPAPIEKTISKAKGQPREPQVYTLPPSREEMTKNQVSLTCLVKG FYPSDIAVEWESNGQPENNYKTTPPVLDSDGSFFLYSKLTVDKSRWQQGNVFSCSV MHEALHNAYTQKSLSLSPGK |
| 180 | PR-1612500L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGGS GGDIRMTQSPSSLSASVGDRVTIECLASEDIYSDLAWYQQKPGKSPKLLTYNANGLQN GVPSRFSGSGSGTDYSLTISSLQPEDVATYFCQQYNYFPGTFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 181 | PR-1612501H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEVQLVQSGAEVKKPGSSVKVSCKASGYTFTNYGMYW VRQAPGQGLEWMGWIDTETGRPTYADDFKGRFTFTADKSTSTAYMELSSLRSEDTA VYYCARWSGDTTGIRGPWFAYWGQGTLVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 182 | PR-1612501L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGGS GGDIRMTQSPSSLSASVGDRVTITCLASEDIYSDLAWYQQKPGKSPKLLTYNANGLQN GVPSRFSGSGSGTDYLTISSLQPEDVATYFCQQYNYFPGTFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 183 | PR-1612502H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEVQLVESGGGLVQPGGSLRLSCAASGFSFSKYDMAWF RQAPGKGLEWVASITTSGVGTYYRDSVKGRFTVSRDNAKSTLYLQMNSLRAEDTAV YYCARGYGAMDAWGQGTTVTVSSASTKGPSVFPLAPSSKSTSGGTAALGCLVKDYF PEPVTVSWNSGALTSGVHTFPAVLQSSGLYSLSSVVTVPSSSLGTQTYICNVNHKPSN TKVDKKVEPKSCDKTHTCPPCPAPEAAGGPSVFLFPPKPKDTLMISRTPEVTCVVVD VSHEDPEVKFNWYVDGVEVHNAKTKPREEQYNSTYRVVSVLTVLHQDWLNGKEY KCKVSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEALH NAYTQKSLSLSPGK |

TABLE 96-continued

Sequences of Exemplary DVD-Ig Binding Proteins

| SEQ ID NO | DVD-Ig | Sequence |
|---|---|---|
| 184 | PR-1612502L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGS GGDIQMTQSPSSLSASVGDRVTITCKASQDIDDYLSWYQQKPGKSPKLVIYAATRLA DGVPSRFSGSGSGTDYTLTISSLQPEDFATYYCLQSSSTPWTFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 185 | PR-1613183H | EVQLVQSGSELKKPGASVKVSCKASGYTFTDYGMYWVRQAPGQGLEWMGWIDTE TGDPTYADDFKGRFVFSLDTSVSTAYLQISSLKAEDTAVYYCARTNYYYRNYMFYF DYWGQGTMVTVSSGGGGSGGGGSEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESSGPKYSFDYWGQGTMVTVSSASTKGPSVFPLAPSSKSTSGGT AALGCLVKDYFPEPVTVSWNSGALTSGVHTFPAVLQSSGLYSLSSVVTVPSSSLGTQ TYICNVNHKPSNTKVDKKVEPKSCDKTHTCPPCPAPEAAGGPSVFLFPPKPKDTLMIS RTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNV FSCSVMHEALHNAYTQKSLSLSPGK |
| 186 | PR-1613183L | EIVLTQSPATLSLSPGERATLFCRASQSVSNHMHWYQQKPGQAPRLLIYGASILESGV PARFSGSGSGTDFTLTISSLEPEDFAVYYCQQSWYDPITFGQGTKLEIKGGSGGGGSG GEIVLTQSPGTLSLSPGERATLSCRASSGSIWYSFVSWYQQKPGQAPRLLIYADDQRA SGIPDRFSGSGSGTDFTLTISRLEPEDFAVYYCQSYGINIDVVFGGGTKVEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 187 | PR-1613184H | EVQLVQSGSELKKPGASVKVSCKASGYTFTDYGMYWVRQAPGQGLEWMGWIDTE TGDPTYADDFKGRFVFSLDTSVSTAYLQISSLKAEDTAVYYCARTNYYYRNYMFYF DYWGQGTMVTVSSGGGGSGGGGSEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESIGTTYSFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 188 | PR-1613184L | EIVLTQSPATLSLSPGERATLFCRASQSVSNHMHWYQQKPGQAPRLLIYGASILESGV PARFSGSGSGTDFTLTISSLEPEDFAVYYCQQSWYDPITFGQGTKLEIKGGSGGGGSG GEFVLTQSPGTLSLSPGERATLSCERSSGDIGDSYVSWYQQKPGQAPRLVIYADDQRP SGIPDRFSGSGSGTDFTLTISRLEPEDFAVYYCQSYDINIDIVFGGGTKVEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 189 | PR-1613185H | EVQLVQSGSELKKPGASVKVSCKASGYTFTDYGMYWVRQAPGQGLEWMGWIDTE TGDPTYADDFKGRFVFSLDTSVSTAYLQISSLKAEDTAVYYCARTNYYYRNYMFYF DYWGQGTMVTVSSGGGGSGGGGSEVQLVQSGAEVKKPGSSVKVSCKASGYTFTES YMYWVKQAPGQGLELIGRIDPEDGSTDYVEKFKNKATLTADKSTSTAYMELSSLRS EDTAVYFCARFGARSYFYPMDAWGQGTTVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 190 | PR-1613185L | EIVLTQSPATLSLSPGERATLFCRASQSVSNHMHWYQQKPGQAPRLLIYGASILESGV PARFSGSGSGTDFTLTISSLEPEDFAVYYCQQSWYDPITFGQGTKLEIKGGSGGGGSG GETVLTQSPATLSLSPGERATLSCRASESVSTLMHWYQQKPGQQPRLLIYGASNLESG VPARFSGSGSGTDFTLTISSLEPEDFAVYFCQQSWNDPWTFGGGTKVEIKRTVAAPSV FIFPPSDEQLKSGTASVVCLLNNFYPREAKVQWKVDNALQSGNSQESVTEQDSKDST YSLSSTLTLSKADYEKHKVYACEVTHQGLSSPVTKSFNRGEC |
| 191 | PR-1613186H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESSGPKYSFDYW GQGTMVTVSSGGGGSGGGGSEVQLVQSGSELKKPGASVKVSCKASGYTFTDYGMY WVRQAPGQGLEWMGWIDTETGDPTYADDFKGRFVFSLDTSVSTAYLQISSLKAEDT AVYYCARTNYYYRNYMFYFDWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH |

TABLE 96-continued

Sequences of Exemplary DVD-Ig Binding Proteins

| SEQ ID NO | DVD-Ig | Sequence |
|---|---|---|
| | | QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 192 | PR-1613186L | EIVLTQSPGTLSLSPGERATLSCRASSGSIWYSFVSWYQQKPGQAPRLLIYADDQRAS GIPDRFSGSGSGTDFTLTISRLEPEDFAVYYCQSYGINIDVVFGGGTKVEIKGGSGGGG SGGEIVLTQSPATLSLSPGERATLFCRASQSVSNHMHWYQQKPGQAPRLLIYGASILE SGVPARFSGSGSGTDFTLTISSLEPEDFAVYYCQQSWYDPITFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 193 | PR-1613187H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSGGGGSGGGGSEVQLVQSGSELKKPGASVKVSCKASGYTFTDYGMY WVRQAPGQGLEWMGWIDTETGDPTYADDFKGRFVFSLDTSVSTAYLQISSLKAEDT AVYYCARTNYYYRNYMFYFDYWGQGTMVTVSSASTKGPSVFPLAPSSKSTSGGTA ALGCLVKDYFPEPVTVSWNSGALTSGVHTFPAVLQSSGLYSLSSVVTVPSSSLGTQT YICNVNHKPSNTKVDKKVEPKSCDKTHTCPPCPAPEAAGGPSVFLFPPKPKDTLMISR TPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFS CSVMHEALHNAYTQKSLSLSPGK |
| 194 | PR-1613187L | EFVLTQSPGTLSLSPGERATLSCERSSGDIGDSYVSWYQQKPGQAPRLVIYADDQRPS GIPDRFSGSGSGTDFTLTISRLEPEDFAVYYCQSYDINIDIVFGGGTKVEIKGGSGGGG SGGEIVLTQSPATLSLSPGERATLFCRASQSVSNHMHWYQQKPGQAPRLLIYGASILE SGVPARFSGSGSGTDFTLTISSLEPEDFAVYYCQQSWYDPITFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 195 | PR-1613188H | EVTLRESGPALVKPTQTLTLTCTFSGFSLSTYGMGVGWIRQPPGKALEWLANIWWD DDKYYNPSLKNRLTISKDTSKNQVVLTMTNMDPVDTATYYCARIESIGTTYSFDYW GQGTMVTVSSGGGGSGGGGSEIQLVQSGSELKKPGASVKVSCKASGYTFTNYGMY WVRQAPGQGLEYMGWINTETGKPTYADDFKGRFVFSLDTSVSTAYLQISSLKAEDT AVYFCARTNYYYRSYIFYFDYWGQGTMVTVSSASTKGPSVFPLAPSSKSTSGGTAAL GCLVKDYFPEPVTVSWNSGALTSGVHTFPAVLQSSGLYSLSSVVTVPSSSLGTQTYIC NVNHKPSNTKVDKKVEPKSCDKTHTCPPCPAPEAAGGPSVFLFPPKPKDTLMISRTPE VTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 196 | PR-1613188L | EFVLTQSPGTLSLSPGERATLSCERSSGDIGDSYVSWYQQKPGQAPRLVIYADDQRPS GIPDRFSGSGSGTDFTLTISRLEPEDFAVYYCQSYDINIDIVFGGGTKVEIKGGSGGGG SGGATQLTQSPSLSASVGDRVTITCRASESVSTHMHWYQQKPGKQPKLLIYGASNLE SGVPSRFSGSGSGTDFTLTISSLQPEDFATYFCQQSWNDPFTFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 197 | PR-1613189H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEVQLVQSGSELKKPGASVKVSCKASGYTFTDYGMYW VRQAPGQGLEWMGWIDTETGDPTYADDFKGRFVFSLDTSVSTAYLQISSLKAEDTA VYYCARTNYYYRNYMFYFDYWGQGTMVTVSSASTKGPSVFPLAPSSKSTSGGTAA LGCLVKDYFPEPVTVSWNSGALTSGVHTFPAVLQSSGLYSLSSVVTVPSSSLGTQTYI CNVNHKPSNTKVDKKVEPKSCDKTHTCPPCPAPEAAGGPSVFLFPPKPKDTLMISRTP EVTCVVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLTCLV KGFYPSDIAVEWESNGQPENNYKTTPPVLDSDGSFFLYSKLTVDKSRWQQGNVFSCS VMHEALHNAYTQKSLSLSPGK |
| 198 | PR-1613189L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGGS GGEIVLTQSPATLSLSPGERATLFCRASQSVSNHMHWYQQKPGQAPRLLIYGASILES GVPARFSGSGSGTDFTLTISSLEPEDFAVYYCQQSWYDPITFGQGTKLEIKRTVAAPS VFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| 199 | PR-1613190H | EVQLVQSGAEVKKPGSSVKVSCKASGYTFTESYMYWVKQAPGQGLELIGRIDPEDG STDYVEKFKNKATLTADKSTSTAYMELSSLRSEDTAVYFCARFGARSYFYPMDAWG QGTTVTVSSGGGGSGGGGSEIQLVQSGSELKKPGASVKVSCKASGYPFTNSGMYWV KQAPGQGLEYMGWINTEAGKPTYADDFKGRFVFSLDTSVSTAYLQISSLKAEDTAV YFCARWGYISDNSYGWFDYWGQGTLVTVSSASTKGPSVFPLAPSSKSTSGGTAALG CLVKDYFPEPVTVSWNSGALTSGVHTFPAVLQSSGLYSLSSVVTVPSSSLGTQTYICN VNHKPSNTKVDKKVEPKSCDKTHTCPPCPAPEAAGGPSVFLFPPKPKDTLMISRTPEV |

TABLE 96-continued

Sequences of Exemplary DVD-Ig Binding Proteins

| SEQ ID NO | DVD-Ig | Sequence |
|---|---|---|
| | | TCVVVDVSHEDPEVKFNWYVDGVEVHNAKTKPREEQYNSTYRVVSVLTVLHQDW LNGKEYKCKVSNKALPAPIEKTISKAKGQPREPQVYTLPPSREEMTKNQVSLTCLVK GFYPSDIAVEWESNGQPENNYKTTPPVLDSDGSFFLYSKLTVDKSRWQQGNVFSCSV MHEALHNAYTQKSLSLSPGK |
| 200 | PR-1613190L | ETVLTQSPATLSLSPGERATLSCRASESVSTLMHWYQQKPGQQPRLLIYGASNLESGV PARFSGSGSGTDFTLTISSLEPEDFAVYFCQQSWNDPWTFGGGTKVEIKGGSGGGGS GGATQLTQSPSSLSASVGDRQVTISCRASEGVYSYMHWYQQKPGKQPKLLIYKASNLA SGVPSRFSGSGSGTDFTLTISSLQPEDFATYFCHQNWNDPLTFGQGTKLEIKRTVAAP SVFIFPPSDEQLKSGTASVVCLLNNFYPREAKVQWKVDNALQSGNSQESVTEQDSKD STYSLSSTLTLSKADYEKHKVYACEVTHQGLSSPVTKSFNRGEC |
| 201 | PR-1629646H | EIQLVQSGSELKKPGASVKVSCKASGYTFTNYGMYWVKQAPGQGLEYMGWIDTET GRPTYADDFKGRFVFSLDTSVSTAYLQISSLKAEDTAVYFCARWSGDTTGIRGPWFA YWGQGTLVTVSSASTKGPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESSGPKYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNAYTQKSLSLSPGK |
| 202 | PR-1629646L | DIRMTQSPSSLSASVGDRVTIECLASEDIYSDLAWYQQKPGKSPKLLIYNANGLQNGV PSRFSGSGSGTDYSLTISSLQPEDVATYFCQQYNYFPGTFGQGTKLEIKRTVAAPSVFI FPPEIVLTQSPGTLSLSPGERATLSCRASSGSIWYSFVSWYQQKPGQAPRLLIYADDQR ASGIPDRFSGSGSGTDFTLTISRLEPEDFAVYYCQSYGINIDVFGGGTKVEIKRTVAA PSVFIFPPSDEQLKSGTASVVCLLNNFYPREAKVQWKVDNALQSGNSQESVTEQDSK DSTYSLSSTLTLSKADYEKHKVYACEVTHQGLSSPVTKSFNRGEC |
| 203 | PR-1629647H | EVQLVESGGGLVQPGGSLRLSCAASGFSFSKYDMAWFRQAPGKGLEWVASITTSGV GTYYRDSVKGRFTVSRDNAKSTLYLQMNSLRAEDTAVYYCARGYGAMDAWGQGT TVTVSSASTKGPEVTLRESGPALVKPTQTLTLTCTFSGFSLSTYGMGVGWIRQPPGKA LEWLANIWWDDDKYYNPSLKNRLTISKDTSKNQVVLTMTNMDPVDTATYYCARIE SSGPKYSFDYWGQGTMVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTK VDKKVEPKSCDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGFYPSDIAV EWESNGQPENNYKTTPPVLDSDGSFFLYSKLTVDKSRWQQGNVFSCSVMHEALHNA YTQKSLSLSPGK |
| 204 | PR-1629647L | DIQMTQSPSSLSASVGDRVTITCKASQDIDDYLSWYQQKPGKSPKLVIYAATRLADG VPSRFSGSGSGTDYTLTISSLQPEDFATYYCLQSSSTPWTFGGGTKVEIKRTVAAPSVF IFPPEIVLTQSPGTLSLSPGERATLSCRASSGSIWYSFVSWYQQKPGQAPRLLIYADDQ RASGIPDRFSGSGSGTDFTLTISRLEPEDFAVYYCQSYGINIDVVFGGGTKVEIKRTVA APSVFIFPPSDEQLKSGTASVVCLLNNFYPREAKVQWKVDNALQSGNSQESVTEQDS KDSTYSLSSTLTLSKADYEKHKVYACEVTHQGLSSPVTKSFNRGEC |
| 205 | PR-1629648H | EIQLVQSGSELKKPGASVKVSCKASGYTFTNYGMYWVKQAPGQGLEYMGWIDTET GRPTYADDFKGRFVFSLDTSVSTAYLQISSLKAEDTAVYFCARWSGDTTGIRGPWFA YWGQGTLVTVSSASTKGPSVFPLAPEVTLRESGPALVKPTQTLTLTCTFSGFSLSTYG MGVGWIRQPPGKALEWLANIWWDDDKYYNPSLKNRLTISKDTSKNQVVLTMTNM DPVDTATYYCARIESSGPKYSFDYWGQGTMVTVSSASTKGPSVFPLAPSSKSTSGGT AALGCLVKDYFPEPVTVSWNSGALTSGVHTFPAVLQSSGLYSLSSVVTVPSSSLGTQ TYICNVNHKPSNTKVDKKVEPKSCDKTHTCPPCPAPEAAGGPSVFLFPPKPKDTLMIS RTPEVTCVVVDVSHEDPEVKFNWYVDGVEVHNAKTKPREEQYNSTYRVVSVLTVL HQDWLNGKEYKCKVSNKALPAPIEKTIMISKAKGQPREPQVYTLPPSREEMTKNQVSLT CLVKGFYPSDIAVEWESNGQPENNYKTTPPVLDSDGSFFLYSKLTVDKSRWQQGNV FSCSVMHEALHNAYTQKSLSLSPGK |
| 206 | PR-1629648L | DIRMTQSPSSLSASVGDRVTIECLASEDIYSDLAWYQQKPGKSPKLLIYNANGLQNGV PSRFSGSGSGTDYSLTISSLQPEDVATYFCQQYNYFPGTFGQGTKLEIKRTVAAPEIVL TQSPGTLSLSPGERATLSCRASSGSIWYSFVSWYQQKPGQAPRLLIYADDQRASGIPD RFSGSGSGTDFTLTISRLEPEDFAVYYCQSYGINIDVVFGGGTKVEIKRTVAAPSVFIFP PSDEQLKSGTASVVCLLNNFYPREAKVQWKVDNALQSGNSQESVTEQDSKDSTYSL SSTLTLSKADYEKHKVYACEVTHQGLSSPVTKSFNRGEC |
| 207 | PR-1629649H | EVQLVESGGGLVQPGGSLRLSCAASGFSFSKYDMAWFRQAPGKGLEWVASITTSGV GTYYRDSVKGRFTVSRDNAKSTLYLQMNSLRAEDTAVYYCARGYGAMDAWGQGT TVTVSSASTKGPSVFPLAPEVTLRESGPALVKPTQTLTLTCTFSGFSLSTYGMGVGWI RQPPGKALEWLANIWWDDDKYYNPSLKNRLTISKDTSKNQVVLTMTNMDPVDTAT YYCARIESSGPKYSFDYWGQGTMVTVSSASTKGPSVFPLAPSSKSTSGGTAALGCLV KDYFPEPVTVSWNSGALTSGVHTFPAVLQSSGLYSLSSVVTVPSSSLGTQTYICNVNH |

TABLE 96-continued

Sequences of Exemplary DVD-Ig Binding Proteins

| SEQ ID NO | DVD-Ig | Sequence |
|---|---|---|
| | | KPSNTKVDKKVEPKSCDKTHTCPPCPAPEAAGGPSVFLFPPKPKDTLMISRTPEVTCV VVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVMHE ALHNAYTQKSLSLSPGK |
| 208 | PR-1629649L | DIQMTQSPSSLSASVGDRVTITCKASQDIDDYLSWYQQKPGKSPKLVIYAATRLADG VPSRFSGSGSGTDYTLTISSLQPEDFATYYCLQSSSTPWTFGGGTKVEIKRTVAAPEIV LTQSPGTLSLSPGERATLSCRASSGSIWYSFVSWYQQKPGQAPRLLIYADDQRASGIP DRFSGSGSGTDFTLTISRLEPEDFAVYYCQSYGINIDVVFGGGTKVEIKRTVAAPSVFI FPPSDEQLKSGTASVVCLLNNFYPREAKVQWKVDNALQSGNSQESVTEQDSKDSTY SLSSTLTLSKADYEKHKVYACEVTHQGLSSPVTKSFNRGEC |

Example 18: PR-1610561 Cell Lines

Chimeric, humanized, and affinity matured antibodies, and DVD-Ig binding proteins were expressed using pHybE vectors. Transient expression of PR-1610561 in HEK cells was also achieved using a vector similar to pHybE-hCg1,z, non-a,mut(234,235) V2. See U.S. Pat. No. 8,187,836.

CHO cell lines producing PR-1610561 have been generated. The growth and productivity of the CHO cell lines were similar to those of other DVD-Ig molecules. All cell lines passed a screening for acceptable product quality by MS, SEC, and CIEX. CHO cell lines were produced using pBJ and pCD plasmid vectors encoding the amino acid sequences of PR-1610561. See US 2014/0295497.

Example 19: Epitope Binning

Antibodies and binding proteins disclosed herein are tested in a label-free cell-based competition assay in order to determine which antibodies and binding proteins are capable of binding to the same antigen (e.g., VEGF, PDGF, or one of their receptors) simultaneously. If antibodies or binding proteins are not able to bind simultaneously (therefore possibly competing for the same or similar epitope), those antibodies or binding proteins are assigned to the same "epitope bin." If antibodies or binding proteins are capable of binding simultaneously and therefore do not compete for antigen binding, those antibodies or binding proteins are assigned to different epitope bins.

INCORPORATION BY REFERENCE

The contents of all cited references (including literature references, patents, patent applications, and websites) that maybe cited throughout this application are hereby expressly incorporated by reference in their entirety for any purpose, as are the references cited therein. To the extent those references contradict or are inconsistent with any statements in this application, the text of the application will control. The disclosure will employ, unless otherwise indicated, conventional techniques of immunology, molecular biology and cell biology, and pathology, which are well known in the art.

EQUIVALENTS

The invention may be embodied in other specific forms without departing from the spirit or essential characteristics thereof. The foregoing embodiments are therefore to be considered in all respects illustrative rather than limiting of the inventions described herein. Scope of the invention is thus indicated by the appended claims rather than by the foregoing description, and all changes that come within the meaning and range of equivalency of the claims are therefore intended to be embraced herein.

SEQUENCE LISTING (3969 sequences)

SEQ ID NO: 1 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2 - protein, 110 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3 - protein, 123 aa, Artificial Sequence
  Description of Artificial Sequence: Synthetic polypeptide
EVTLRESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSS

SEQ ID NO: 4 - protein, 110 aa, Artificial Sequence
  Description of Artificial Sequence: Synthetic polypeptide
DFVLTQSPDSLAVSLGERATINCERSSGDIGDTYVSWYQQKPGQPPKNVIYGNDQRPSGVPDRFSGSGSGNSATLTISSLQAEDVAVYFCQSYDSDIDIVFGGGTKVEIK

SEQ ID NO: 5 - protein, 122 aa, Artificial Sequence
  Description of Artificial Sequence: Synthetic polypeptide
EVQLVESGGGLVQPGGSLRLSCAFSGFSLSTYGMGVGWIRQAPGKGLEWLANIWWDDDKYYNPSLKNRLTISKDTSKNQAYLQINSLRAEDTAVYYCARIESIGTTYSFDYWGQGTLVTVSS

SEQ ID NO: 6 - protein, 110 aa, Artificial Sequence
  Description of Artificial Sequence: Synthetic polypeptide
DFQLTQSPSSLSASVGDRVTITCERSSGDIGDSYVSWYQQKPGKAPKNVIYADDQRPSGVPSRFSGSGSGNSASLTISSLQPEDFATYYCQSYDINIDIVFGQGTKVEIK

SEQ ID NO: 7 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQAVLTITNMDPVDTATYYCARIESIGTTYSFDYWGQGTTVTVSS

SEQ ID NO: 8 - protein, 110 aa, Artificial Sequence
  Description of Artificial Sequence: Synthetic polypeptide
DFVLTQSPDSLAVSLGERATINCERSSGDIGDSYVSWYQQKPGQPPKNVIYADDQRPSGVPDRFSGSGSGNSASLTISSLQAEDVAVYFCQSYDINIDIVFGGGTKVEIK

SEQ ID NO: 9 - protein, 122 aa, Artificial Sequence; identical to SEQ ID NO: 5
  Description of Artificial Sequence: Synthetic polypeptide

SEQ ID NO: 10 - protein, 110 aa, Artificial Sequence; identical to SEQ ID NO: 6
  Description of Artificial Sequence: Synthetic polypeptide

SEQ ID NO: 11 - protein, 122 aa, Artificial Sequence; identical to SEQ ID NO: 1
  Description of Artificial Sequence: Synthetic polypeptide

SEQ ID NO: 12 - protein, 110 aa, Artificial Sequence
  Description of Artificial Sequence: Synthetic polypeptide
EFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIK

SEQ ID NO: 13 - protein, 121 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSS

SEQ ID NO: 14 - protein, 107 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIK

SEQ ID NO: 15 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSS

SEQ ID NO: 16 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIK

SEQ ID NO: 17 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 18 - protein, 107 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK

SEQ ID NO: 19 - protein, 123 aa, Artificial Sequence
  Description of Artificial Sequence: Synthetic polypeptide
EIQLVQSGTEVKKPGESLKISCKASGYTFTNYGMYWVKQMPGKGLEYMGWINTETGKPTYADDFKGRFTFSLDKSFNTAFLQWSSLKASDTAMYFCARTNYYYRSYIFYFDYWGQGTMVTVSS

SEQ ID NO: 20 - protein, 107 aa, Artificial Sequence
  Description of Artificial Sequence: Synthetic polypeptide
ETVLTQSPATLSVSPGERATLSCRASESVSTHMHWYQQKPGQAPRLLIYGASNLESGVPARFSGSGSGTDFTLTISSLQSEDFAVYFCQQSWNDPFTFGQGTRLEIK

SEQ ID NO: 21 - protein, 123 aa, Artificial Sequence
  Description of Artificial Sequence: Synthetic polypeptide
EIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSS

SEQ ID NO: 22 - protein, 107 aa, Artificial Sequence
  Description of Artificial Sequence: Synthetic polypeptide
DTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIK

SEQ ID NO: 23 - protein, 123 aa, Artificial Sequence
  Description of Artificial Sequence: Synthetic polypeptide
EVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSS

SEQ ID NO: 24 - protein, 107 aa, Artificial Sequence
  Description of Artificial Sequence: Synthetic polypeptide
DTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIK

SEQ ID NO: 25 - protein, 120 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSS

SEQ ID NO: 26 - protein, 107 aa, Artificial Sequence
  Description of Artificial Sequence: Synthetic polypeptide
DTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIK

SEQ ID NO: 27 - protein, 123 aa, Artificial Sequence; identical to SEQ ID NO: 17
  Description of Artificial Sequence: Synthetic polypeptide

SEQ ID NO: 28 - protein, 106 aa, Artificial Sequence
  Description of Artificial Sequence: Synthetic polypeptide
ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIK

SEQ ID NO: 29 - protein, 123 aa, Artificial Sequence
  Description of Artificial Sequence: Synthetic polypeptide
EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSS

SEQ ID NO: 30 - protein, 107 aa, Artificial Sequence
  Description of Artificial Sequence: Synthetic polypeptide
AIQLTQSPSSLSASVGDRVTITCRASESVSTHMHWYQQKPGKAPKLLIYGASNLESGVPSRFSGSGSGTDFTLTISSLQPEDFATYYCQQSWNDPFTFGQGTKLEIK

SEQ ID NO: 31 - protein, 123 aa, Artificial Sequence; identical to SEQ ID NO: 29
  Description of Artificial Sequence: Synthetic polypeptide

SEQ ID NO: 32 - protein, 106 aa, Artificial Sequence; identical to SEQ ID NO: 28
  Description of Artificial Sequence: Synthetic polypeptide

SEQ ID NO: 33 - protein, 123 aa, Artificial Sequence
  Description of Artificial Sequence: Synthetic polypeptide
EIQLVQSGAEVKKPGASVKVSCKASGYTFTNYGMYWVRQAPGQGLEYMGWINTETGKPTYADDFKGRFTFTLDTSTSTAYMELRSLRSDDTAVYFCARTNYYYRSYIFYFDYWGQGTMVTVSS

SEQ ID NO: 34 - protein, 107 aa, Artificial Sequence; identical to SEQ ID NO: 18
  Description of Artificial Sequence: Synthetic polypeptide

SEQ ID NO: 35 - protein, 124 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSS

SEQ ID NO: 36 - protein, 107 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIK

SEQ ID NO: 37 - protein, 124 aa, Artificial Sequence
  Description of Artificial Sequence: Synthetic polypeptide
EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSS

SEQ ID NO: 38 - protein, 107 aa, Artificial Sequence
  Description of Artificial Sequence: Synthetic polypeptide
DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIK

SEQ ID NO: 39 - protein, 116 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSS

SEQ ID NO: 40 - protein, 107 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIK

SEQ ID NO: 41 - protein, 123 aa, Artificial Sequence
  Description of Artificial Sequence: Synthetic polypeptide
EIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSS

SEQ ID NO: 42 - protein, 107 aa, Artificial Sequence
  Description of Artificial Sequence: Synthetic polypeptide
ATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIK

SEQ ID NO: 43 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSS

SEQ ID NO: 44 - protein, 107 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIK

SEQ ID NO: 45 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGGGGSGDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 581 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 330 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGTVAAPDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 581 aa, Artificial Sequence; identical to SEQ ID NO: 47
  Description of Artificial Sequence: Synthetic polypeptide

SEQ ID NO: 50 - protein, 337 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGTVAAPSVFIFPPDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 588 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 330 aa, Artificial Sequence; identical to SEQ ID NO: 48
  Description of Artificial Sequence: Synthetic polypeptide

SEQ ID NO: 53 - protein, 585 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 334 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 581 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 330 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 581 aa, Artificial Sequence; identical to SEQ ID NO: 55
  Description of Artificial Sequence: Synthetic polypeptide

SEQ ID NO: 58 - protein, 337 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 588 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPSVFPLAPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 330 aa, Artificial Sequence; identical to SEQ ID NO: 56
  Description of Artificial Sequence: Synthetic polypeptide

SEQ ID NO: 61 - protein, 582 aa, Artificial Sequence
  Description of Artificial Sequence: Synthetic polypeptide
EVTLRESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSASTKGPEIQLVQSGTEVKKPGESLKISCKASGYTFTNYGMYWVKQMPGKGLEYMGWINTETGKPTYADDFKGRFTFSLDKSFNTAFLQWSSLKASDTAMYFCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 337 aa, Artificial Sequence
  Description of Artificial Sequence: Synthetic polypeptide
DFVLTQSPDSLAVSLGERATINCERSSGDIGDTYVSWYQQKPGQPPKNVIYGNDQRPSGVPDRFSGSGSGNSATLTISSLQAEDVAVYFCQSYDSDIDIVFGGGTKVEIKGTVAAPSVFIFPPETVLTQSPATLSVSPGERATLSCRASESVSTHMHWYQQKPGQAPRLLIYGASNLESGVPARFSGSGSGTDFTLTISSLQSEDFAVYFCQQSWNDPFTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 582 aa, Artificial Sequence
  Description of Artificial Sequence: Synthetic polypeptide
EVTLRESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSASTKGPEIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 311 aa, Artificial Sequence
  Description of Artificial Sequence: Synthetic polypeptide
DFVLTQSPDSLAVSLGERATINCERSSGDIGDTYVSWYQQKPGQPPKNVIYGNDQRPSGVPDRFSGSGSGNSATLTISSLQAEDVAVYFCQSYDSDIDIVFGGGTKVEIKGTVAAPSVFIFPPDTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEK

SEQ ID NO: 65 - protein, 337 aa, Artificial Sequence
  Description of Artificial Sequence: Synthetic polypeptide
DFVLTQSPDSLAVSLGERATINCERSSGDIGDTYVSWYQQKPGQPPKNVIYGNDQRPSGVPDRFSGSGSGNSATLTISSLQAEDVAVYFCQSYDSDIDIVFGGGTKVEIKGTVAAPSVFIFPPDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 582 aa, Artificial Sequence
  Description of Artificial Sequence: Synthetic polypeptide
EVQLVESGGGLVQPGGSLRLSCAFSGFSLSTFGMGVGWIRQAPGKGLEWLANIWWDDDKYYNPSLKNRLTISKDTSKNQAYLQINSLRAEDTAVYYCARISTGISSYYVMDAWGQGTLVTVSSASTKGPEIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 337 aa, Artificial Sequence
  Description of Artificial Sequence: Synthetic polypeptide
DFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGTVAAPSVFIFPPDTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 582 aa, Artificial Sequence
  Description of Artificial Sequence: Synthetic polypeptide
EVQLVESGGGLVQPGGSLRLSCAFSGFSLSTFGMGVGWIRQAPGKGLEWLANIWWDDDKYYNPSLKNRLTISKDTSKNQAYLQINSLRAEDTAVYYCARISTGISSYYVMDAWGQGTLVTVSSASTKGPEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 337 aa, Artificial Sequence
  Description of Artificial Sequence: Synthetic polypeptide
DFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGTVAAPSVFIFPPDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 581 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQAVLTITNMDPVDTATYYCARIESIGTTYSFDYWGQGTTVTVSSASTKGPEIQLVQSGTEVKKPGESLKISCKASGYTFTNYGMYWVKQMPGKGLEYMGWINTETGKPTYADDFKGRFTFSLDKSFNTAFLQWSSLKASDTAMYFCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 337 aa, Artificial Sequence
  Description of Artificial Sequence: Synthetic polypeptide
DFVLTQSPDSLAVSLGERATINCERSSGDIGDSYVSWYQQKPGQPPKNVIYADDQRPSGVPDRFSGSGSGNSASLTISSLQAEDVAVYFCQSYDINIDIVFGGGTKVEIKGTVAAPSVFIFPPETVLTQSPATLSVSPGERATLSCRASESVSTHMHWYQQKPGQAPRLLIYGASNLESGVPARFSGSGSGTDFTLTISSLQSEDFAVYFCQQSWNDPFTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 581 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQAVLTITNMDPVDTATYYCARIESIGTTYSFDYWGQGTTVTVSSASTKGPEIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 337 aa, Artificial Sequence
  Description of Artificial Sequence: Synthetic polypeptide
DFVLTQSPDSLAVSLGERATINCERSSGDIGDSYVSWYQQKPGQPPKNVIYADDQRPSGVPDRFSGSGSGNSASLTISSLQAEDVAVYFCQSYDINIDIVFGGGTKVEIKGTVAAPSVFIFPPDTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 581 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQAVLTITNMDPVDTATYYCARIESIGTTYSFDYWGQGTTVTVSSASTKGPEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 337 aa, Artificial Sequence
  Description of Artificial Sequence: Synthetic polypeptide
DFVLTQSPDSLAVSLGERATINCERSSGDIGDSYVSWYQQKPGQPPKNVIYADDQRPSGVPDRFSGSGSGNSASLTISSLQAEDVAVYFCQSYDINIDIVFGGGTKVEIKGTVAAPSVFIFPPDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 76 - protein, 581 aa, Artificial Sequence
  Description of Artificial Sequence: Synthetic polypeptide
EVQLVESGGGLVQPGGSLRLSCAFSGFSLSTYGMGVGWIRQAPGKGLEWLANIWWDDDKYYNPSLKNRLTISKDTSKNQAYLQINSLRAEDTAVYYCARIESIGTTYSFDYWGQGTLVTVSSASTKGPEIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 337 aa, Artificial Sequence
  Description of Artificial Sequence: Synthetic polypeptide
DFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGTVAAPSVFIFPPDTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 581 aa, Artificial Sequence
  Description of Artificial Sequence: Synthetic polypeptide
EVQLVESGGGLVQPGGSLRLSCAFSGFSLSTYGMGVGWIRQAPGKGLEWLANIWWDDDKYYNPSLKNRLTISKDTSKNQAYLQINSLRAEDTAVYYCARIESIGTTYSFDYWGQGTLVTVSSASTKGPEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 337 aa, Artificial Sequence
  Description of Artificial Sequence: Synthetic polypeptide
DFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGTVAAPSVFIFPPDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 80 - protein, 582 aa, Artificial Sequence
  Description of Artificial Sequence: Synthetic polypeptide
EVTLRESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSASTKGPEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 337 aa, Artificial Sequence; identical to SEQ ID NO: 69
  Description of Artificial Sequence: Synthetic polypeptide

SEQ ID NO: 82 - protein, 581 aa, Artificial Sequence; identical to SEQ ID NO: 74
  Description of Artificial Sequence: Synthetic polypeptide

SEQ ID NO: 83 - protein, 337 aa, Artificial Sequence; identical to SEQ ID NO: 77
  Description of Artificial Sequence: Synthetic polypeptide

SEQ ID NO: 84 - protein, 585 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 85 - protein, 334 aa, Artificial Sequence; identical to SEQ ID NO: 54
  Description of Artificial Sequence: Synthetic polypeptide

SEQ ID NO: 86 - protein, 581 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 87 - protein, 337 aa, Artificial Sequence; identical to SEQ ID NO: 58
  Description of Artificial Sequence: Synthetic polypeptide

SEQ ID NO: 88 - protein, 585 aa, Artificial Sequence; identical to SEQ ID NO: 84
  Description of Artificial Sequence: Synthetic polypeptide

SEQ ID NO: 89 - protein, 334 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 585 aa, Artificial Sequence; identical to SEQ ID NO: 84
  Description of Artificial Sequence: Synthetic polypeptide

SEQ ID NO: 91 - protein, 335 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 585 aa, Artificial Sequence; identical to SEQ ID NO: 84
  Description of Artificial Sequence: Synthetic polypeptide

SEQ ID NO: 93 - protein, 334 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 581 aa, Artificial Sequence; identical to SEQ ID NO: 86
  Description of Artificial Sequence: Synthetic polypeptide

SEQ ID NO: 95 - protein, 337 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 588 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSASTKGPSVFPLAPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 97 - protein, 330 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 330 aa, Artificial Sequence; identical to SEQ ID NO: 56
  Description of Artificial Sequence: Synthetic polypeptide

SEQ ID NO: 99 - protein, 585 aa, Artificial Sequence; identical to SEQ ID NO: 84
  Description of Artificial Sequence: Synthetic polypeptide

SEQ ID NO: 100 - protein, 334 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRGGSGGGGSGEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 581 aa, Artificial Sequence; identical to SEQ ID NO: 86
  Description of Artificial Sequence: Synthetic polypeptide

SEQ ID NO: 102 - protein, 337 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPSVFIFPPEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 588 aa, Artificial Sequence; identical to SEQ ID NO: 96
  Description of Artificial Sequence: Synthetic polypeptide

SEQ ID NO: 104 - protein, 330 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKRTVAAPEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 582 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 106 - protein, 334 aa, Artificial Sequence
  Description of Artificial Sequence: Synthetic polypeptide
DTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRGGSGGGGSGEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 578 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSASTKGPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 108 - protein, 337 aa, Artificial Sequence
  Description of Artificial Sequence: Synthetic polypeptide
DTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRTVAAPSVFIFPPEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 585 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSASTKGPSVFPLAPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 110 - protein, 330 aa, Artificial Sequence
  Description of Artificial Sequence: Synthetic polypeptide
DTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRTVAAPEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 578 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPEVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 112 - protein, 337 aa, Artificial Sequence
  Description of Artificial Sequence: Synthetic polypeptide
EFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPSVFIFPPDTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPEVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 114 - protein, 330 aa, Artificial Sequence
  Description of Artificial Sequence: Synthetic polypeptide
EFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRTVAAPDTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 115 - protein, 582 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 116 - protein, 334 aa, Artificial Sequence
  Description of Artificial Sequence: Synthetic polypeptide
EFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKRGGSGGGGSGDTQLTQSPSSLSASVGDRVTITCRASESVSTVIHWYQQKPGKQPKLLIHGASNLESGVPSRFSGSGSGTDFTLTISSLQPEDFATYFCQQHWNDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 117 - protein, 585 aa, Artificial Sequence; identical to SEQ ID NO: 53
  Description of Artificial Sequence: Synthetic polypeptide

SEQ ID NO: 118 - protein, 333 aa, Artificial Sequence
  Description of Artificial Sequence: Synthetic polypeptide
ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 585 aa, Artificial Sequence
  Description of Artificial Sequence: Synthetic polypeptide
EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 334 aa, Artificial Sequence
  Description of Artificial Sequence: Synthetic polypeptide
AIQLTQSPSSLSASVGDRVTITCRASESVSTHMHWYQQKPGKAPKLLIYGASNLESGVPSRFSGSGSGTDFTLTISSLQPEDFATYYCQQSWNDPFTFGQGTKLEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 585 aa, Artificial Sequence; identical to SEQ ID NO: 119
  Description of Artificial Sequence: Synthetic polypeptide

SEQ ID NO: 122 - protein, 333 aa, Artificial Sequence; identical to SEQ ID NO: 118
  Description of Artificial Sequence: Synthetic polypeptide

SEQ ID NO: 123 - protein, 585 aa, Artificial Sequence
  Description of Artificial Sequence: Synthetic polypeptide
EIQLVQSGAEVKKPGASVKVSCKASGYTFTNYGMYWVRQAPGQGLEYMGWINTETGKPTYADDFKGRFTFTLDTSTSTAYMELRSLRSDDTAVYFCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 334 aa, Artificial Sequence; identical to SEQ ID NO: 89
  Description of Artificial Sequence: Synthetic polypeptide

SEQ ID NO: 125 - protein, 585 aa, Artificial Sequence
  Description of Artificial Sequence: Synthetic polypeptide
EIQLVQSGTEVKKPGESLKISCKASGYTFTNYGMYWVKQMPGKGLEYMGWINTETGKPTYADDFKGRFTFSLDKSFNTAFLQWSSLKASDTAMYFCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 334 aa, Artificial Sequence
  Description of Artificial Sequence: Synthetic polypeptide
ETVLTQSPATLSVSPGERATLSCRASESVSTHMHWYQQKPGQAPRLLIYGASNLESGVPARFSGSGSGTDFTLTISSLQSEDFAVYFCQQSWNDPFTFGQGTRLEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 585 aa, Artificial Sequence
  Description of Artificial Sequence: Synthetic polypeptide
EIQLVQSGGGVVQPGGSLRLSCAASGYTFTNYGMYWVKQAPGKGLEYMGWINTETGKPTYADDFKGRFTFSLDTSKSTAYLQLNSLRAEDTAVYFCARTNYYYRSYIFYFDYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 334 aa, Artificial Sequence
  Description of Artificial Sequence: Synthetic polypeptide
DTVLTQSPSTLSASPGERATISCRASESVSTHMHWYQQKPGQAPKLLIYGASNLESGVPSRFSGSRSGTDFTLTISSLQPEDFAVYFCQQSWNDPFTFGQGTKVEIKRGGSGGGGSGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 584 aa, Artificial Sequence
  Description of Artificial Sequence: Synthetic polypeptide
EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 130 - protein, 330 aa, Artificial Sequence
  Description of Artificial Sequence: Synthetic polypeptide
ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 131 - protein, 586 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 132 - protein, 334 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 585 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 134 - protein, 331 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - protein, 585 aa, Artificial Sequence
  Description of Artificial Sequence: Synthetic polypeptide
EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 136 - protein, 331 aa, Artificial Sequence
  Description of Artificial Sequence: Synthetic polypeptide
DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 577 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 138 - protein, 331 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 585 aa, Artificial Sequence
  Description of Artificial Sequence: Synthetic polypeptide
EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 140 - protein, 333 aa, Artificial Sequence
  Description of Artificial Sequence: Synthetic polypeptide
ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 578 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 142 - protein, 334 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 585 aa, Artificial Sequence
  Description of Artificial Sequence: Synthetic polypeptide
EIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 144 - protein, 334 aa, Artificial Sequence
  Description of Artificial Sequence: Synthetic polypeptide
ATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 585 aa, Artificial Sequence
  Description of Artificial Sequence: Synthetic polypeptide
EIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 146 - protein, 334 aa, Artificial Sequence
  Description of Artificial Sequence: Synthetic polypeptide
ATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 586 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 148 - protein, 334 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGDIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 149 - protein, 586 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 150 - protein, 334 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGDIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 152 - protein, 334 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 586 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 154 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGDIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 155 - protein, 586 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 156 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGDIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 578 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 158 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGDIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 160 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 585 aa, Artificial Sequence
  Description of Artificial Sequence: Synthetic polypeptide
EIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 162 - protein, 333 aa, Artificial Sequence
  Description of Artificial Sequence: Synthetic polypeptide
ATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 586 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 164 - protein, 334 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - protein, 586 aa, Artificial Sequence
  Description of Artificial Sequence: Synthetic polypeptide
EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 166 - protein, 334 aa, Artificial Sequence
  Description of Artificial Sequence: Synthetic polypeptide
DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 586 aa, Artificial Sequence
  Description of Artificial Sequence: Synthetic polypeptide
EVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 168 - protein, 334 aa, Artificial Sequence
  Description of Artificial Sequence: Synthetic polypeptide
DIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 169 - protein, 578 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 170 - protein, 334 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 584 aa, Artificial Sequence
  Description of Artificial Sequence: Synthetic polypeptide
EIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 172 - protein, 331 aa, Artificial Sequence
  Description of Artificial Sequence: Synthetic polypeptide
ATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 174 - protein, 333 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 175 - protein, 578 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 176 - protein, 334 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGDIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 177 - protein, 584 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 178 - protein, 330 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 179 - protein, 585 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 180 - protein, 331 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGDIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - protein, 585 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEVQLVQSGAEVKKPGSSVKVSCKASGYTFTNYGMYWVRQAPGQGLEWMGWIDTETGRPTYADDFKGRFTFTADKSTSTAYMELSSLRSEDTAVYYCARWSGDTTGIRGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 182 - protein, 331 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGDIRMTQSPSSLSASVGDRVTITCLASEDIYSDLAWYQQKPGKSPKLLIYNANGLQNGVPSRFSGSGSGTDYTLTISSLQPEDVATYFCQQYNYFPGTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 183 - protein, 577 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 184 - protein, 331 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGDIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 585 aa, Artificial Sequence
  Description of Artificial Sequence: Synthetic polypeptide
EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 186 - protein, 334 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKGGSGGGGSGGEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 187 - protein, 585 aa, Artificial Sequence
  Description of Artificial Sequence: Synthetic polypeptide
EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 188 - protein, 334 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKGGSGGGGSGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - protein, 584 aa, Artificial Sequence
  Description of Artificial Sequence: Synthetic polypeptide
EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSGGGGSGGGGSEVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 190 - protein, 331 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKGGSGGGGSGGETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSGGGGSGGGGSEVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 192 - protein, 334 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKGGSGGGGSGGEIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 193 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 194 - protein, 334 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGEIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 195 - protein, 585 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSEIQLVQSGSELKKPGASVKVSCKASGYTFTNYGMYWVRQAPGQGLEYMGWINTETGKPTYADDFKGRFVFSLDTSVSTAYLQISSLKAEDTAVYFCARTNYYYRSYIFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 196 - protein, 333 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSGGGGSGGATQLTQSPSLSASVGDRVTITCRASESVSTHMHWYQQKPGKQPKLLIYGASNLESGVPSRFSGSGSGTDFTLTISSLQPEDFATYFCQQSWNDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 584 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYRNYMFYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 198 - protein, 331 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGEIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 584 aa, Artificial Sequence
  Description of Artificial Sequence: Synthetic polypeptide
EVQLVQSGAEVKKPGSSVKVSCKASGYTFTESYMYWVKQAPGQGLELIGRIDPEDGSTDYVEKFKNKATLTADKSTSTAYMELSSLRSEDTAVYFCARFGARSYFYPMDAWGQGTTVTVSSGGGGSGGGGSEIQLVQSGSELKKPGASVKVSCKASGYPFTNSGMYWVKQAPGQGLEYMGWINTEAGKPTYADDFKGRFVFSLDTSVSTAYLQISSLKAEDTAVYFCARWGYISDNSYGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 200 - protein, 331 aa, Artificial Sequence
  Description of Artificial Sequence: Synthetic polypeptide
ETVLTQSPATLSLSPGERATLSCRASESVSTLMHWYQQKPGQQPRLLIYGASNLESGVPARFSGSGSGTDFTLTISSLEPEDFAVYFCQQSWNDPWTFGGGTKVEIKGGSGGGGSGGATQLTQSPSSLSASVGDRVTISCRASEGVYSYMHWYQQKPGKQPKLLIYKASNLASGVPSRFSGSGSGTDFTLTISSLQPEDFATYFCHQNWNDPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 201 - protein, 582 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSASTKGPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 202 - protein, 337 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKRTVAAPSVFIFPPEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 203 - protein, 574 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSASTKGPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 204 - protein, 337 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKRTVAAPSVFIFPPEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 589 aa, Artificial Sequence
  Description of Artificial Sequence: Synthetic polypeptide
EIQLVQSGSELKKPGASVKVSCKASGYTFTNYGMYWVKQAPGQGLEYMGWIDTETGRPTYADDFKGRFVFSLDTSVSTAYLQISSLKAEDTAVYFCARWSGDTTGIRGPWFAYWGQGTLVTVSSASTKGPSVFPLAPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 206 - protein, 330 aa, Artificial Sequence
  Description of Artificial Sequence: Synthetic polypeptide
DIRMTQSPSSLSASVGDRVTIECLASEDIYSDLAWYQQKPGKSPKLLIYNANGLQNGVPSRFSGSGSGTDYSLTISSLQPEDVATYFCQQYNYFPGTFGQGTKLEIKRTVAAPEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 581 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKSTLYLQMNSLRAEDTAVYYCARGYGAMDAWGQGTTVTVSSASTKGPSVFPLAPEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 208 - protein, 330 aa, Artificial Sequence
  Description of Artificial Sequence: Synthetic polypeptide
DIQMTQSPSSLSASVGDRVTITCKASQDIDDYLSWYQQKPGKSPKLVIYAATRLADGVPSRFSGSGSGTDYTLTISSLQPEDFATYYCLQSSSTPWTFGGGTKVEIKRTVAAPEIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - protein, 582 aa, Artificial Sequence; identical to SEQ ID NO: 80
  Description of Artificial Sequence: Synthetic polypeptide

SEQ ID NO: 210 - protein, 588 aa, Artificial Sequence; identical to SEQ ID NO: 96
  Description of Artificial Sequence: Synthetic polypeptide

SEQ ID NO: 211 - protein, 123 aa, Artificial Sequence
  Description of Artificial Sequence: Synthetic polypeptide
EVQLVESGGGLVQPGGSLRLSCAFSGFSLSTFGMGVGWIRQAPGKGLEWLANIWWDDDKYYNPSLKNRLTISKDTSKNQAYLQINSLRAEDTAVYYCARISTGISSYYVMDAWGQGTLVTVSS

SEQ ID NO: 212 - protein, 110 aa, Artificial Sequence
  Description of Artificial Sequence: Synthetic polypeptide
DFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIK

SEQ ID NO: 213 - protein, 578 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGEVTLRESGPALVKPTQTLTLTCTFSGFSLSTYGMGVGWIRQPPGKGLEWLANIWWDDDKYYNPSLKNRLTISKDTSKNQAVLTITNMDPVDTATYYCARIESIGTTYSFDYWGQGTMVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 336 aa, Artificial Sequence
  Description of Artificial Sequence: Synthetic polypeptide
DFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGGGSGGGDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 215 - protein, 578 aa, Artificial Sequence
  Description of Artificial Sequence: Synthetic polypeptide
EVTLRESGPALVKPTQTLTLTCTFSGFSLSTYGMGVGWIRQPPGKGLEWLANIWWDDDKYYNPSLKNRLTISKDTSKNQAVLTITNMDPVDTATYYCARIESIGTTYSFDYWGQGTMVTVSSGEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 336 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKGGGSGGGDFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 579 aa, Artificial Sequence
  Description of Artificial Sequence: Synthetic polypeptide
EVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSGEVTLKESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 336 aa, Artificial Sequence
  Description of Artificial Sequence: Synthetic polypeptide
DFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGGGSGGGDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 579 aa, Artificial Sequence
  Description of Artificial Sequence: Synthetic polypeptide
EVTLKESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSGEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 336 aa, Artificial Sequence
  Description of Artificial Sequence: Synthetic polypeptide
DTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKGGGSGGGDFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 578 aa, Artificial Sequence
  Description of Artificial Sequence: Synthetic polypeptide
EVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSGEVTLRESGPALVKPTQTLTLTCTFSGFSLSTYGMGVGWIRQPPGKGLEWLANIWWDDDKYYNPSLKNRLTISKDTSKNQAVLTITNMDPVDTATYYCARIESIGTTYSFDYWGQGTMVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 336 aa, Artificial Sequence
  Description of Artificial Sequence: Synthetic polypeptide
DFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGGGSGGGDTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 578 aa, Artificial Sequence
  Description of Artificial Sequence: Synthetic polypeptide
EVTLRESGPALVKPTQTLTLTCTFSGFSLSTYGMGVGWIRQPPGKGLEWLANIWWDDDKYYNPSLKNRLTISKDTSKNQAVLTITNMDPVDTATYYCARIESIGTTYSFDYWGQGTMVTVSSGEVQLVESGGGLVQPGGSLRLSCAASGYTFTNYGMYWVKQAPGKGLEYMGWINTETGKPTYADDFKGRFTFSLDTSKSTAYLQMNSLRAEDTAVYFCARTNYYYRSYIFYFDYWGQGTLVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 336 aa, Artificial Sequence
  Description of Artificial Sequence: Synthetic polypeptide
DTQLTQSPSSLSASVGDRVTISCRASESVSTHMHWYQQKPGKAPKLLIYGASNLESGVPSRFSGSGSGTDFTLTISSLQPEDFATYFCQQSWNDPFTFGQGTKVEIKGGGSGGGDFQLTQSPSSLSASVGDRVTITCERSSGDIGDSYVSWYQQKPGKAPKNVIYADDQRPSGVPSRFSGSGSGNSASLTISSLQPEDFATYFCQSYDINIDIVFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 578 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 226 - protein, 336 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGGGDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 578 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 228 - protein, 336 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - protein, 578 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGGSEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 230 - protein, 351 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 231 - protein, 576 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 232 - protein, 349 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 233 - protein, 574 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 234 - protein, 349 aa, Artificial Sequence; identical to SEQ ID NO: 232
  Description of Artificial Sequence: Synthetic polypeptide

SEQ ID NO: 235 - protein, 571 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 236 - protein, 349 aa, Artificial Sequence; identical to SEQ ID NO: 232
  Description of Artificial Sequence: Synthetic polypeptide

SEQ ID NO: 237 - protein, 576 aa, Artificial Sequence; identical to SEQ ID NO: 231
  Description of Artificial Sequence: Synthetic polypeptide

SEQ ID NO: 238 - protein, 347 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 576 aa, Artificial Sequence; identical to SEQ ID NO: 231
  Description of Artificial Sequence: Synthetic polypeptide

SEQ ID NO: 240 - protein, 344 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 559 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGGGEFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 242 - protein, 355 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 559 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGGGDTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 244 - protein, 355 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 575 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGGGGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSLGGCGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 246 - protein, 356 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGGGGEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSLGGCGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 579 aa, Artificial Sequence
  Description of Artificial Sequence: Synthetic polypeptide
EFVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGSGGGGEVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSLGGCGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 248 - protein, 352 aa, Artificial Sequence
  Description of Artificial Sequence: Synthetic polypeptide
DTVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIKGGGSGGGGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSLGGCGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 576 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSSGGGGSGGGEFVLTQSPGTLSLSPGERATLSCERSSGDIGESYVSWYQQKPGQAPRLVIYADDQRPSGIPDRFSGSGSGTDFTLTISRLEPEDFAVYYCQSYDINIDIVFGGGTKVEIKGGGSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 250 - protein, 347 aa, Artificial Sequence; identical to SEQ ID NO: 238
  Description of Artificial Sequence: Synthetic polypeptide

SEQ ID NO: 251 - protein, 576 aa, Artificial Sequence; identical to SEQ ID NO: 249
  Description of Artificial Sequence: Synthetic polypeptide

SEQ ID NO: 252 - protein, 344 aa, Artificial Sequence; identical to SEQ ID NO: 240
  Description of Artificial Sequence: Synthetic polypeptide

SEQ ID NO: 253 - protein, 165 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 254 - protein, 121 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 255 - protein, 111 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 256 - protein, 165 aa, Macaca fascicularis; identical to SEQ ID NO: 253

SEQ ID NO: 257 - protein, 164 aa, Mus musculus
APTTEGEQKSHEVIKFMDVYQRSYCRPIETLVDIFQEYPDEIEYIFKPSCVPLMRCAGCCNDEALECVPTSESNITMQIMRIKPHQSQHIERMSFLQHSRCECRPKKDRTKPENHCEPCSERRKHLFVQDPQTCKCSCKNTDSRCKARQLELNERTCRCDKPRR

SEQ ID NO: 258 - protein, 164 aa, Rattus norvegicus
APTTEGEQKAHEVVKFMDVYQRSYCRPIETLVDIFQEYPDEIEYIFKPSCVPLMRCAGCCNDEALECVPTSESNVTMQIMRIKPHQSQHIGEMSFLQHSRCECRPKKDRTKPENHCEPCSERRKHLFVQDPQTCKCSCKNTDSRCKARQLELNERTCRCDKPRR

SEQ ID NO: 259 - protein, 191 aa, Oryctolagus cuniculus
MNFLLSWVHWSLALLLYLHHAKWSQAAPMAEEGDNKPHEVVKFMEVYRRSYCQPIETLVDIFQEYPDEIEYIFKPSCVPLVRCGGCCNDESLECVPTEEFNVTMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 260 - protein, 109 aa, Homo sapiens
SLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVT

SEQ ID NO: 261 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 262 - protein, 109 aa, Macaca fascicularis
SLGSLTVAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVT

SEQ ID NO: 263 - protein, 109 aa, Mus musculus
SLGSLAAAEPAVIAECKTRTEVFQISRNLIDRTNANFLVWPPCVEVQRCSGCCNNRNVQCRASQVQMRPVQVRKIEIVRKKPIFKKATVTLEDHLACKCETIVTPRPVT

SEQ ID NO: 264 - protein, 109 aa, Rattus norvegicus
SLGSLAAAEPAVIAECKTRTEVFQISRNLIDRTNANFLVWPPCVEVQRCSGCCNNRNVQCRASQVQMRPVQVRKIEIVRKKPVFKKATVTLEDHLACKCETVVTPRPVT

SEQ ID NO: 265 - protein, 109 aa, Oryctolagus cuniculus; identical to SEQ ID NO: 264

SEQ ID NO: 266 - protein, 330 aa, Homo sapiens
ASTKGPSVFFLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGK

SEQ ID NO: 269 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNRYTQKSLSLSPGK

SEQ ID NO: 270 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPAPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFRLYSKLTVDKSRWQQGNVFSCSVMHEALHNHYTQKSLSLSPGK

SEQ ID NO: 271 - protein, 107 aa, Homo sapiens [sequence omitted]

SEQ ID NO: 272 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 273 - protein, 30 aa, Artificial Sequence
  Description of Artificial Sequence: Synthetic polypeptide
EVQLVESGGGLVQPGGSLRLSCAASGFTFS

SEQ ID NO: 274 - protein, 14 aa, Artificial Sequence
  Description of Artificial Sequence: Synthetic peptide
WVRQAPGKGLEWVA

SEQ ID NO: 275 - protein, 32 aa, Artificial Sequence
  Description of Artificial Sequence: Synthetic polypeptide
RFTISRDNAKNSLYLQMNSLRAEDTAVYYCAR

SEQ ID NO: 276 - protein, 11 aa, Artificial Sequence
  Description of Artificial Sequence: Synthetic peptide
WGQGTLVTVSS

SEQ ID NO: 277 - protein, 30 aa, Artificial Sequence; identical to SEQ ID NO: 273
  Description of Artificial Sequence: Synthetic polypeptide

SEQ ID NO: 278 - protein, 14 aa, Artificial Sequence
  Description of Artificial Sequence: Synthetic peptide
WVRQAPGKGLEWVS

SEQ ID NO: 279 - protein, 32 aa, Artificial Sequence
  Description of Artificial Sequence: Synthetic polypeptide
RFTISRDNSKNTLYLQMNSLRAEDTAVYYCAR

SEQ ID NO: 280 - protein, 11 aa, Artificial Sequence
  Description of Artificial Sequence: Synthetic peptide
WGQGTLVTVSS

SEQ ID NO: 281 - protein, 30 aa, Artificial Sequence
  Description of Artificial Sequence: Synthetic polypeptide
QVQLVQSGAEVKKPGASVKVSCKASGYTFT

SEQ ID NO: 282 - protein, 14 aa, Artificial Sequence
  Description of Artificial Sequence: Synthetic peptide
WVRQAPGQGLEWMG

SEQ ID NO: 283 - protein, 32 aa, Artificial Sequence
  Description of Artificial Sequence: Synthetic polypeptide
RVTMTRDTSTSTVYMELSSLRSEDTAVYYCAR

SEQ ID NO: 284 - protein, 11 aa, Artificial Sequence
  Description of Artificial Sequence: Synthetic peptide
WGQGTLVTVSS

SEQ ID NO: 285 - protein, 30 aa, Artificial Sequence
  Description of Artificial Sequence: Synthetic polypeptide
QVQLVESGGGVVQPGRSLRLSCAASGFTFS

SEQ ID NO: 286 - protein, 14 aa, Artificial Sequence
  Description of Artificial Sequence: Synthetic peptide
WVRQAPGKGLEWVA

SEQ ID NO: 287 - protein, 32 aa, Artificial Sequence; identical to SEQ ID NO: 279
  Description of Artificial Sequence: Synthetic polypeptide

SEQ ID NO: 288 - protein, 11 aa, Artificial Sequence
  Description of Artificial Sequence: Synthetic peptide
WGQGTMVTVSS

SEQ ID NO: 289 - protein, 30 aa, Artificial Sequence; identical to SEQ ID NO: 273
  Description of Artificial Sequence: Synthetic polypeptide

SEQ ID NO: 290 - protein, 14 aa, Artificial Sequence
  Description of Artificial Sequence: Synthetic peptide
WVRQAPGKGLEWVS

SEQ ID NO: 291 - protein, 32 aa, Artificial Sequence; identical to SEQ ID NO: 279
  Description of Artificial Sequence: Synthetic polypeptide

SEQ ID NO: 292 - protein, 11 aa, Artificial Sequence
  Description of Artificial Sequence: Synthetic peptide
WGQGTMVTVSS

SEQ ID NO: 293 - protein, 30 aa, Artificial Sequence
  Description of Artificial Sequence: Synthetic polypeptide
EVTLRESGPALVKPTQTLTLTCTFSGFSLS

SEQ ID NO: 294 - protein, 14 aa, Artificial Sequence
  Description of Artificial Sequence: Synthetic peptide
WIRQPPGKALEWLA

SEQ ID NO: 295 - protein, 32 aa, Artificial Sequence
  Description of Artificial Sequence: Synthetic polypeptide
RLTISKDTSKNQVVLTMTNMDPVDTATYYCAR

SEQ ID NO: 296 - protein, 11 aa, Artificial Sequence
  Description of Artificial Sequence: Synthetic peptide
WGQGTTVTVSS

SEQ ID NO: 297 - protein, 30 aa, Artificial Sequence
  Description of Artificial Sequence: Synthetic polypeptide
EVTLKESGPVLVKPTETLTLTCTVSGFSLS

SEQ ID NO: 298 - protein, 14 aa, Artificial Sequence
  Description of Artificial Sequence: Synthetic peptide
WIRQPPGKALEWLA

SEQ ID NO: 299 - protein, 32 aa, Artificial Sequence
  Description of Artificial Sequence: Synthetic polypeptide
RLTISKDTSKSQVVLTMTNMDPVDTATYYCAR

SEQ ID NO: 300 - protein, 11 aa, Artificial Sequence
  Description of Artificial Sequence: Synthetic peptide
WGQGTTVTVSS

SEQ ID NO: 301 - protein, 30 aa, Artificial Sequence; identical to SEQ ID NO: 273
  Description of Artificial Sequence: Synthetic polypeptide

SEQ ID NO: 302 - protein, 14 aa, Artificial Sequence
  Description of Artificial Sequence: Synthetic peptide
WVRQAPGKGLEWVG

SEQ ID NO: 303 - protein, 32 aa, Artificial Sequence
  Description of Artificial Sequence: Synthetic polypeptide
RFTISRDDSKNSLYLQMNSLKTEDTAVYYCAR

SEQ ID NO: 304 - protein, 11 aa, Artificial Sequence
  Description of Artificial Sequence: Synthetic peptide
WGQGTTVTVSS

SEQ ID NO: 305 - protein, 30 aa, Artificial Sequence
  Description of Artificial Sequence: Synthetic polypeptide
EVQLVESGGGLVKPGGSLRLSCAASGFTFS

SEQ ID NO: 306 - protein, 14 aa, Artificial Sequence
  Description of Artificial Sequence: Synthetic peptide
WVRQAPGKGLEWVS

SEQ ID NO: 307 - protein, 32 aa, Artificial Sequence; identical to SEQ ID NO: 275
  Description of Artificial Sequence: Synthetic polypeptide

SEQ ID NO: 308 - protein, 11 aa, Artificial Sequence
  Description of Artificial Sequence: Synthetic peptide
WGQGTTVTVSS

SEQ ID NO: 309 - protein, 30 aa, Artificial Sequence
  Description of Artificial Sequence: Synthetic polypeptide
EVQLVQSGAEVKKPGSSVKVSCKASGGTFS

SEQ ID NO: 310 - protein, 14 aa, Artificial Sequence
  Description of Artificial Sequence: Synthetic peptide
WVRQAPGQGLEWMG

SEQ ID NO: 311 - protein, 32 aa, Artificial Sequence
  Description of Artificial Sequence: Synthetic polypeptide
RVTITADKSTSTAYMELSSLRSEDTAVYYCAR

SEQ ID NO: 312 - protein, 11 aa, Artificial Sequence
  Description of Artificial Sequence: Synthetic peptide
WGQGTTVTVSS

SEQ ID NO: 313 - protein, 30 aa, Artificial Sequence
  Description of Artificial Sequence: Synthetic polypeptide
EVQLVQSGAEVKKPGASVKVSCKASGYTFT

SEQ ID NO: 314 - protein, 14 aa, Artificial Sequence
  Description of Artificial Sequence: Synthetic peptide
WVRQAPGQGLEWMG

SEQ ID NO: 315 - protein, 32 aa, Artificial Sequence
  Description of Artificial Sequence: Synthetic polypeptide
RVTMTTDTSTSTAYMELRSLRSDDTAVYYCAR

SEQ ID NO: 316 - protein, 11 aa, Artificial Sequence
  Description of Artificial Sequence: Synthetic peptide
WGQGTTVTVSS

SEQ ID NO: 317 - protein, 30 aa, Artificial Sequence
  Description of Artificial Sequence: Synthetic polypeptide
EVQLQESGPGLVKPSETLSLTCTVSGGSIS

SEQ ID NO: 318 - protein, 14 aa, Artificial Sequence
  Description of Artificial Sequence: Synthetic peptide
WIRQPPGKGLEWIG

SEQ ID NO: 319 - protein, 32 aa, Artificial Sequence
  Description of Artificial Sequence: Synthetic polypeptide
RVTISVDTSKNQFSLKLSSVTAADTAVYYCAR

SEQ ID NO: 320 - protein, 11 aa, Artificial Sequence
  Description of Artificial Sequence: Synthetic peptide
WGQGTLVTVSS

SEQ ID NO: 321 - protein, 30 aa, Artificial Sequence
  Description of Artificial Sequence: Synthetic polypeptide
EVQLVESGGGLVQPGGSLRLSCAVSGGSIS

SEQ ID NO: 322 - protein, 14 aa, Artificial Sequence
  Description of Artificial Sequence: Synthetic peptide
WIRQAPGKGLEWIG

SEQ ID NO: 323 - protein, 32 aa, Artificial Sequence
  Description of Artificial Sequence: Synthetic polypeptide
RVTISVDTSKNSFYLQMNSLRAEDTAVYYCAR

SEQ ID NO: 324 - protein, 11 aa, Artificial Sequence
  Description of Artificial Sequence: Synthetic peptide
WGQGTLVTVSS

SEQ ID NO: 325 - protein, 30 aa, Artificial Sequence
  Description of Artificial Sequence: Synthetic polypeptide
EVQLQESGPGLVKPGETLSLTCTVSGGSIS

SEQ ID NO: 326 - protein, 14 aa, Artificial Sequence
  Description of Artificial Sequence: Synthetic peptide
WIRQAPGKGLEWIG

SEQ ID NO: 327 - protein, 32 aa, Artificial Sequence
  Description of Artificial Sequence: Synthetic polypeptide
RVTISVDTSKNQFYLKLSSVRAEDTAVYYCAR

SEQ ID NO: 328 - protein, 11 aa, Artificial Sequence
  Description of Artificial Sequence: Synthetic peptide
WGQGTLVTVSS

SEQ ID NO: 329 - protein, 30 aa, Artificial Sequence
  Description of Artificial Sequence: Synthetic polypeptide
EVQLVQSGTEVKKPGESLKISCKVSGGSIS

SEQ ID NO: 330 - protein, 14 aa, Artificial Sequence
  Description of Artificial Sequence: Synthetic peptide
WIRQMPGKGLEWIG

SEQ ID NO: 331 - protein, 32 aa, Artificial Sequence
  Description of Artificial Sequence: Synthetic polypeptide
QVTISVDTSFNTFFLQWSSLKASDTAMYYCAR

SEQ ID NO: 332 - protein, 11 aa, Artificial Sequence
  Description of Artificial Sequence: Synthetic peptide
WGQGTMVTVSS

SEQ ID NO: 333 - protein, 30 aa, Artificial Sequence
  Description of Artificial Sequence: Synthetic polypeptide
EVTLRESGPALVKPTQTLTLTCTVSGGSIS

SEQ ID NO: 334 - protein, 14 aa, Artificial Sequence
  Description of Artificial Sequence: Synthetic peptide
WIRQPPGKGLEWIG

SEQ ID NO: 335 - protein, 32 aa, Artificial Sequence
  Description of Artificial Sequence: Synthetic polypeptide
RVTISVDTSKNQFVLTMTNMDPVDTATYYCAR

SEQ ID NO: 336 - protein, 11 aa, Artificial Sequence
  Description of Artificial Sequence: Synthetic peptide
WGQGTTVTVSS

SEQ ID NO: 337 - protein, 30 aa, Artificial Sequence
  Description of Artificial Sequence: Synthetic polypeptide
EVQLLESGGGLVKSGGSLRLSCAASGFTFR

SEQ ID NO: 338 - protein, 14 aa, Artificial Sequence
  Description of Artificial Sequence: Synthetic peptide
WVRQAPGKGLEWVA

SEQ ID NO: 339 - protein, 32 aa, Artificial Sequence
  Description of Artificial Sequence: Synthetic polypeptide
RFTISRDNSKNTLYLQLNSLRAEDTAVYYCAK

SEQ ID NO: 340 - protein, 11 aa, Artificial Sequence
  Description of Artificial Sequence: Synthetic peptide
WGQGTMVTVSS

SEQ ID NO: 341 - protein, 30 aa, Artificial Sequence
  Description of Artificial Sequence: Synthetic polypeptide
EVQLVESGGGVVQPGGSLRLSCAASGFTFG

SEQ ID NO: 342 - protein, 14 aa, Artificial Sequence
  Description of Artificial Sequence: Synthetic peptide
WVRQAPGKGLEWVA

SEQ ID NO: 343 - protein, 32 aa, Artificial Sequence; identical to SEQ ID NO: 339
  Description of Artificial Sequence: Synthetic polypeptide

SEQ ID NO: 344 - protein, 11 aa, Artificial Sequence
  Description of Artificial Sequence: Synthetic peptide
WGQGTMVTVSS

SEQ ID NO: 345 - protein, 23 aa, Artificial Sequence
  Description of Artificial Sequence: Synthetic peptide
DIQMTQSPSSLSASVGDRVTITC

SEQ ID NO: 346 - protein, 15 aa, Artificial Sequence
  Description of Artificial Sequence: Synthetic peptide
WYQQKPGKAPKLLIY

SEQ ID NO: 347 - protein, 32 aa, Artificial Sequence
  Description of Artificial Sequence: Synthetic polypeptide
GVPSRFSGSGSGTDFTLTISSLQPEDFATYYC

SEQ ID NO: 348 - protein, 10 aa, Artificial Sequence
  Description of Artificial Sequence: Synthetic peptide
FGQGTKLEIK

SEQ ID NO: 349 - protein, 23 aa, Artificial Sequence
  Description of Artificial Sequence: Synthetic peptide
EIVMTQSPATLSVSPGERATLSC

SEQ ID NO: 350 - protein, 15 aa, Artificial Sequence
  Description of Artificial Sequence: Synthetic peptide
WYQQKPGQAPRLLIY

SEQ ID NO: 351 - protein, 32 aa, Artificial Sequence
  Description of Artificial Sequence: Synthetic polypeptide
GIPARFSGSGSGTEFTLTISSLQSEDFAVYYC

SEQ ID NO: 352 - protein, 10 aa, Artificial Sequence
  Description of Artificial Sequence: Synthetic peptide
FGQGTKLEIK

SEQ ID NO: 353 - protein, 23 aa, Artificial Sequence
  Description of Artificial Sequence: Synthetic peptide
DIVMTQSPDSLAVSLGERATINC

SEQ ID NO: 354 - protein, 15 aa, Artificial Sequence
  Description of Artificial Sequence: Synthetic peptide
WYQQKPGQPPKLLIY

SEQ ID NO: 355 - protein, 32 aa, Artificial Sequence
  Description of Artificial Sequence: Synthetic polypeptide
GVPDRFSGSGSGTDFTLTISSLQAEDVAVYYC

SEQ ID NO: 356 - protein, 11 aa, Artificial Sequence
  Description of Artificial Sequence: Synthetic peptide
FGGGTKVEIKR

SEQ ID NO: 357 - protein, 23 aa, Artificial Sequence
  Description of Artificial Sequence: Synthetic peptide
EIVMTQSPATLSVSPGERATLSC

SEQ ID NO: 358 - protein, 15 aa, Artificial Sequence
  Description of Artificial Sequence: Synthetic peptide
WYQQKPGQAPRLLIY

SEQ ID NO: 359 - protein, 32 aa, Artificial Sequence; identical to SEQ ID NO: 351
  Description of Artificial Sequence: Synthetic polypeptide

SEQ ID NO: 360 - protein, 11 aa, Artificial Sequence
  Description of Artificial Sequence: Synthetic peptide
FGGGTKVEIKR

SEQ ID NO: 361 - protein, 23 aa, Artificial Sequence
  Description of Artificial Sequence: Synthetic peptide
DIQMTQSPSSLSASVGDRVTITC

SEQ ID NO: 362 - protein, 15 aa, Artificial Sequence
  Description of Artificial Sequence: Synthetic peptide
WYQQKPEKAPKSLIY

SEQ ID NO: 363 - protein, 32 aa, Artificial Sequence; identical to SEQ ID NO: 347
  Description of Artificial Sequence: Synthetic polypeptide

SEQ ID NO: 364 - protein, 11 aa, Artificial Sequence
  Description of Artificial Sequence: Synthetic peptide
FGGGTKVEIKR

SEQ ID NO: 365 - protein, 23 aa, Artificial Sequence
  Description of Artificial Sequence: Synthetic peptide
DIQMTQSPSSVSASVGDRVTITC

SEQ ID NO: 366 - protein, 15 aa, Artificial Sequence
  Description of Artificial Sequence: Synthetic peptide
WYQQKPGKAPKLLIY

SEQ ID NO: 367 - protein, 32 aa, Artificial Sequence; identical to SEQ ID NO: 347
  Description of Artificial Sequence: Synthetic polypeptide

SEQ ID NO: 368 - protein, 11 aa, Artificial Sequence
  Description of Artificial Sequence: Synthetic peptide
FGGGTKVEIKR

SEQ ID NO: 369 - protein, 22 aa, Artificial Sequence
  Description of Artificial Sequence: Synthetic peptide
SYELTQPPSVSVSPGQTASITC

SEQ ID NO: 370 - protein, 15 aa, Artificial Sequence
  Description of Artificial Sequence: Synthetic peptide
WYQQKPGQSPVLVIY

SEQ ID NO: 371 - protein, 32 aa, Artificial Sequence
  Description of Artificial Sequence: Synthetic polypeptide
GIPERFSGSNSGDTATLTISGTQPMDEADYYC

SEQ ID NO: 372 - protein, 10 aa, Artificial Sequence
  Description of Artificial Sequence: Synthetic peptide
FGYGTKVTVL

SEQ ID NO: 373 - protein, 22 aa, Artificial Sequence
  Description of Artificial Sequence: Synthetic peptide
SYELTQPPSVSVSPGQTASITC

SEQ ID NO: 374 - protein, 15 aa, Artificial Sequence
  Description of Artificial Sequence: Synthetic peptide
WYQQKPGQSPVLVIY

SEQ ID NO: 375 - protein, 32 aa, Artificial Sequence; identical to SEQ ID NO: 371
  Description of Artificial Sequence: Synthetic polypeptide

SEQ ID NO: 376 - protein, 10 aa, Artificial Sequence
  Description of Artificial Sequence: Synthetic peptide
GGGTKLTVLG

SEQ ID NO: 377 - protein, 21 aa, Artificial Sequence
  Description of Artificial Sequence: Synthetic peptide
YELTQPPSVSVSPGQTASITC

SEQ ID NO: 378 - protein, 15 aa, Artificial Sequence
  Description of Artificial Sequence: Synthetic peptide
WYQQKPGQSPVLVIY

SEQ ID NO: 379 - protein, 32 aa, Artificial Sequence; identical to SEQ ID NO: 371
  Description of Artificial Sequence: Synthetic polypeptide

SEQ ID NO: 380 - protein, 10 aa, Artificial Sequence
  Description of Artificial Sequence: Synthetic peptide
GGGTKLTVLG

SEQ ID NO: 381 - protein, 22 aa, Artificial Sequence
  Description of Artificial Sequence: Synthetic peptide
LYVLTQPPSVSVSPGQTASITC

SEQ ID NO: 382 - protein, 15 aa, Artificial Sequence
  Description of Artificial Sequence: Synthetic peptide
WYQQKPGQSPVLVIY

SEQ ID NO: 383 - protein, 32 aa, Artificial Sequence
  Description of Artificial Sequence: Synthetic polypeptide
GIPERFSGSNSGDTATLTISGTQTMDEADYLC

SEQ ID NO: 384 - protein, 11 aa, Artificial Sequence
  Description of Artificial Sequence: Synthetic peptide
FGGGTKVTVLG

SEQ ID NO: 385 - protein, 23 aa, Artificial Sequence
  Description of Artificial Sequence: Synthetic peptide
EYVLTQSPDFQSVTPKEKVTITC

SEQ ID NO: 386 - protein, 15 aa, Artificial Sequence
  Description of Artificial Sequence: Synthetic peptide
WYQQKPDQSPKLVIY

SEQ ID NO: 387 - protein, 32 aa, Artificial Sequence
  Description of Artificial Sequence: Synthetic polypeptide
GVPSRFSGSNSGDDATLTINSLEAEDAATYYC

SEQ ID NO: 388 - protein, 11 aa, Artificial Sequence
  Description of Artificial Sequence: Synthetic peptide
FGQGTKVEIKR

SEQ ID NO: 389 - protein, 23 aa, Artificial Sequence
  Description of Artificial Sequence: Synthetic peptide
EYVLTQSPATLSVSPGERATLSC

SEQ ID NO: 390 - protein, 15 aa, Artificial Sequence
  Description of Artificial Sequence: Synthetic peptide
WYQQKPGQSPRLVIY

SEQ ID NO: 391 - protein, 32 aa, Artificial Sequence
  Description of Artificial Sequence: Synthetic polypeptide
DIPARFSGSNSGDEATLTISSLQSEDFAVYYC

SEQ ID NO: 392 - protein, 11 aa, Artificial Sequence
  Description of Artificial Sequence: Synthetic peptide
FGQGTRLEIKR

SEQ ID NO: 393 - protein, 23 aa, Artificial Sequence
  Description of Artificial Sequence: Synthetic peptide
DYVLTQSPDSLAVSLGERATINC

SEQ ID NO: 394 - protein, 15 aa, Artificial Sequence
  Description of Artificial Sequence: Synthetic peptide
WYQQKPGQSPKLVIY

SEQ ID NO: 395 - protein, 32 aa, Artificial Sequence
  Description of Artificial Sequence: Synthetic polypeptide
GIPDRFSGSNSGDDATLTISSLQAEDVAVYYC

SEQ ID NO: 396 - protein, 11 aa, Artificial Sequence
  Description of Artificial Sequence: Synthetic peptide
FGGGTKVEIKR

SEQ ID NO: 397 - protein, 22 aa, Artificial Sequence
  Description of Artificial Sequence: Synthetic peptide
LPVLTQPPSVSVSPGQTASITC

SEQ ID NO: 398 - protein, 15 aa, Artificial Sequence
  Description of Artificial Sequence: Synthetic peptide
WYQQKPGQSPVLVIY

SEQ ID NO: 399 - protein, 32 aa, Artificial Sequence
  Description of Artificial Sequence: Synthetic polypeptide
GIPERFSGSNSGNTATLTISGTQTMDEADYLC

SEQ ID NO: 400 - protein, 10 aa, Artificial Sequence
  Description of Artificial Sequence: Synthetic peptide
FGGGTKVTVL

SEQ ID NO: 401 - protein, 22 aa, Artificial Sequence
  Description of Artificial Sequence: Synthetic peptide
SYELTQPPSVSVSPGQTASITC

SEQ ID NO: 402 - protein, 15 aa, Artificial Sequence
  Description of Artificial Sequence: Synthetic peptide
WYQQKPGQSPVLVIY

SEQ ID NO: 403 - protein, 32 aa, Artificial Sequence; identical to SEQ ID NO: 399
  Description of Artificial Sequence: Synthetic polypeptide

SEQ ID NO: 404 - protein, 10 aa, Artificial Sequence
  Description of Artificial Sequence: Synthetic peptide
FGGGTKLTVL

SEQ ID NO: 405 - protein, 6 aa, Artificial Sequence
  Description of Artificial Sequence: Synthetic 6xHis tag
HHHHHH

SEQ ID NO: 406 - protein, 123 aa, Artificial Sequence
  Description of Artificial Sequence: Synthetic polypeptide
QIQLVQSGPELKKPGESVKISCKASGYTFTNYGMYWVKQAPGQGLQYMGWINTETGKPTYADDFKGRFVFFLETSASTAYLQINNLKNEDMATYFCARTNYYYRSYIFYFDYWGQGTMVTVSS

SEQ ID NO: 407 - protein, 10 aa, Artificial Sequence
  Description of Artificial Sequence: Synthetic peptide
GYTFTNYGMY

SEQ ID NO: 408 - protein, 17 aa, Artificial Sequence
  Description of Artificial Sequence: Synthetic peptide
WINTETGKPTYADDFKG

SEQ ID NO: 409 - protein, 14 aa, Artificial Sequence
  Description of Artificial Sequence: Synthetic peptide
TNYYYRSYIFYFDY

SEQ ID NO: 410 - protein, 106 aa, Artificial Sequence
  Description of Artificial Sequence: Synthetic polypeptide
DTVLTQSPALAVSPGERVSISCRASESVSTHMHWYQQKPGQQPKLLIYGASNLESGVPARFSGSGSGTDFTLTIDPVEADDTATYFCQQSWNDPFTFGAVTKLELK

SEQ ID NO: 411 - protein, 11 aa, Artificial Sequence
  Description of Artificial Sequence: Synthetic peptide
RASESVSTHMH

SEQ ID NO: 412 - protein, 7 aa, Artificial Sequence
  Description of Artificial Sequence: Synthetic peptide
GASNLES

SEQ ID NO: 413 - protein, 9 aa, Artificial Sequence
  Description of Artificial Sequence: Synthetic peptide
QQSWNDPFT

SEQ ID NO: 414 - protein, 120 aa, Artificial Sequence
  Description of Artificial Sequence: Synthetic polypeptide
QVQLQQSGTELVKPGSSVKISCKASGYTFTSNYMHWIRQQPGNGLEWIGWIYPGDGDTNYNHNFNGKATLTADKSSSTAYMQLSSLTSEDFAVYFCASSTRAIPGWFTYWGQGTLVTVSS

SEQ ID NO: 415 - protein, 10 aa, Artificial Sequence
  Description of Artificial Sequence: Synthetic peptide
GYTFTSNYMH

SEQ ID NO: 416 - protein, 17 aa, Artificial Sequence
  Description of Artificial Sequence: Synthetic peptide
WIYPGDGDTNYNHNFNG

SEQ ID NO: 417 - protein, 11 aa, Artificial Sequence
  Description of Artificial Sequence: Synthetic peptide
STRAIPGWFTY

SEQ ID NO: 418 - protein, 106 aa, Artificial Sequence
  Description of Artificial Sequence: Synthetic polypeptide
DTVLTQSPALAVSPGERVSISCWASESVSTLMHWYQQKLGQQPKLLIYGASNLESGVPARFRGSGSGTDFTLTIDPVEADDTATYFCQQSWSDPYTFGAGTKLELK

SEQ ID NO: 419 - protein, 11 aa, Artificial Sequence
  Description of Artificial Sequence: Synthetic peptide
WASESVSTLMH

SEQ ID NO: 420 - protein, 7 aa, Artificial Sequence
  Description of Artificial Sequence: Synthetic peptide
GASNLES

SEQ ID NO: 421 - protein, 9 aa, Artificial Sequence
  Description of Artificial Sequence: Synthetic peptide
QQSWSDPYT

SEQ ID NO: 422 - protein, 120 aa, Artificial Sequence
  Description of Artificial Sequence: Synthetic polypeptide
QIQLVQSGPELKKPGESVKISCKASGYSFTNFGLYWVKQAPGQGLQYMGWIDTETGKPTYADDFRGRFVFFLETSASTAYLQINNLKNEDMATYFCARVYGYPSWYFDFWGPGTMVTVSS

SEQ ID NO: 423 - protein, 10 aa, Artificial Sequence
  Description of Artificial Sequence: Synthetic peptide
GYSFTNFGLY

SEQ ID NO: 424 - protein, 17 aa, Artificial Sequence
  Description of Artificial Sequence: Synthetic peptide
WIDTETGKPTYADDFRG

SEQ ID NO: 425 - protein, 11 aa, Artificial Sequence
  Description of Artificial Sequence: Synthetic peptide
VYGYPSWYFDF

SEQ ID NO: 426 - protein, 107 aa, Artificial Sequence
  Description of Artificial Sequence: Synthetic polypeptide
DIQMTQSPASLSTSLEEIVTITCQASQDIDNYLSWYQQKPGKSPQLLIHSATSLADGVPSRFSGSRSGTQFSLKIHRLQVEDTGIYYCLQHFFPPWTFGGGTKLELK

SEQ ID NO: 427 - protein, 11 aa, Artificial Sequence
  Description of Artificial Sequence: Synthetic peptide
QASQDIDNYLS

SEQ ID NO: 428 - protein, 7 aa, Artificial Sequence
  Description of Artificial Sequence: Synthetic peptide
SATSLAD

SEQ ID NO: 429 - protein, 9 aa, Artificial Sequence
  Description of Artificial Sequence: Synthetic peptide
LQHFFPPWT

SEQ ID NO: 430 - protein, 116 aa, Artificial Sequence
  Description of Artificial Sequence: Synthetic polypeptide
EVQLVESGGGLVQPGRSLKLSCAASGFSFSKYDMAWFRQTPTKGLEWVASITTSGVGTYYRDSVKGRFTVSRDNAKSTLYLQMDSLRSEDTATYYCARGYGAMDAWGQGTSVTVSS

SEQ ID NO: 431 - protein, 10 aa, Artificial Sequence
  Description of Artificial Sequence: Synthetic peptide
GFSFSKYDMA

SEQ ID NO: 432 - protein, 17 aa, Artificial Sequence
  Description of Artificial Sequence: Synthetic peptide
SITTSGVGTYYRDSVKG

SEQ ID NO: 433 - protein, 7 aa, Artificial Sequence
  Description of Artificial Sequence: Synthetic peptide
GYGAMDA

SEQ ID NO: 434 - protein, 107 aa, Artificial Sequence
  Description of Artificial Sequence: Synthetic polypeptide
DIQMTQSPASLSASLEEIVTITCKASQDIDDYLSWYQQKPGKSPQLVIYAATRLADGVPSRFSGSGSGTQYSLKISRLQVDDSGIYYCLQSSSTPWTFGGGTNLELK

SEQ ID NO: 435 - protein, 11 aa, Artificial Sequence
  Description of Artificial Sequence: Synthetic peptide
KASQDIDDYLS

SEQ ID NO: 436 - protein, 7 aa, Artificial Sequence
  Description of Artificial Sequence: Synthetic peptide
AATRLAD

SEQ ID NO: 437 - protein, 9 aa, Artificial Sequence
  Description of Artificial Sequence: Synthetic peptide
LQSSSTPWT

SEQ ID NO: 438 - protein, 124 aa, Artificial Sequence
  Description of Artificial Sequence: Synthetic polypeptide
QIQLVQSGPELKKPGESVKISCKASGYSFTNYGMYWVKQAPGQGLQYMGWIDTETGKPTYTDDFKGRFVFFLETSASTAYLQINNLKNEDMATYFCARWSGDTAGIRGPWFAYWGQGTLVTVSS

SEQ ID NO: 439 - protein, 10 aa, Artificial Sequence
  Description of Artificial Sequence: Synthetic peptide
GYSFTNYGMY

SEQ ID NO: 440 - protein, 17 aa, Artificial Sequence
  Description of Artificial Sequence: Synthetic peptide
WIDTETGKPTYTDDFKG

SEQ ID NO: 441 - protein, 15 aa, Artificial Sequence
  Description of Artificial Sequence: Synthetic peptide
WSGDTAGIRGPWFAY

SEQ ID NO: 442 - protein, 107 aa, Artificial Sequence
  Description of Artificial Sequence: Synthetic polypeptide
DIRMTQSPASLSASLGETVNIECLASEDIYSDLAWYQQKPGKSPQLLIYNANDLQKGVPSRFSGSGSGTQYSLKINSLQSEDVATYFCQQYNYYPGTFGAGTKLELK

SEQ ID NO: 443 - protein, 11 aa, Artificial Sequence
  Description of Artificial Sequence: Synthetic peptide
LASEDIYSDLA

SEQ ID NO: 444 - protein, 7 aa, Artificial Sequence
  Description of Artificial Sequence: Synthetic peptide
NANDLQK

SEQ ID NO: 445 - protein, 9 aa, Artificial Sequence
  Description of Artificial Sequence: Synthetic peptide
QQYNYYPGT

SEQ ID NO: 446 - protein, 121 aa, Artificial Sequence
  Description of Artificial Sequence: Synthetic polypeptide
QIQLVQSGPELKKPGESVKISCKASGYTFTNYGMYWVKQAPGQGLQYMGWINTETGKPTYADDFKGRFVFFLETSASTAYFQINNLKNEDLATYFCARPSDYYDGFWFPYWGQGTLVTVSS

SEQ ID NO: 447 - protein, 10 aa, Artificial Sequence
  Description of Artificial Sequence: Synthetic peptide
GYTFTNYGMY

SEQ ID NO: 448 - protein, 17 aa, Artificial Sequence
  Description of Artificial Sequence: Synthetic peptide
WINTETGKPTYADDFKG

SEQ ID NO: 449 - protein, 12 aa, Artificial Sequence
  Description of Artificial Sequence: Synthetic peptide
PSDYYDGFWFPY

SEQ ID NO: 450 - protein, 106 aa, Artificial Sequence
  Description of Artificial Sequence: Synthetic polypeptide
DTALTQSPALAVSPGERVSISCRASEGVNSYMHWYQQSPGQQPKLLIYKASNLASGVPARFSGSGSGTDFTLTIDPVEADDTATYFCQQSWYDPLTFGSGTKLEIK

SEQ ID NO: 451 - protein, 11 aa, Artificial Sequence
  Description of Artificial Sequence: Synthetic peptide
RASEGVNSYMH

SEQ ID NO: 452 - protein, 7 aa, Artificial Sequence
  Description of Artificial Sequence: Synthetic peptide
KASNLAS

SEQ ID NO: 453 - protein, 9 aa, Artificial Sequence
  Description of Artificial Sequence: Synthetic peptide
QQSWYDPLT

SEQ ID NO: 454 - protein, 123 aa, Artificial Sequence
  Description of Artificial Sequence: Synthetic polypeptide
QIQLVQSGPELKKPGESVKISCKASGYPFTNSGMYWVKQAPGQGLQYMGWINTEAGKPTYADDFKGRFVFFLETSASTAYLQINNLKNEDMATYFCARWGYISDNSYGWFDYWGQGTLVTVSS

SEQ ID NO: 455 - protein, 10 aa, Artificial Sequence
  Description of Artificial Sequence: Synthetic peptide
GYPFTNSGMY

SEQ ID NO: 456 - protein, 17 aa, Artificial Sequence
  Description of Artificial Sequence: Synthetic peptide
WINTEAGKPTYADDFKG

SEQ ID NO: 457 - protein, 14 aa, Artificial Sequence
  Description of Artificial Sequence: Synthetic peptide
WGYISDNSYGWFDY

SEQ ID NO: 458 - protein, 106 aa, Artificial Sequence
  Description of Artificial Sequence: Synthetic polypeptide
DTVLTQSPALAVSPGERVSISCRASEGVYSYMHWYQQNPGQQPKLLIYKASNLASGVPARFSGSGSGTDFTLTIDPVEADDTATYFCHQNWNDPLTFGSGTKLEIK

SEQ ID NO: 459 - protein, 11 aa, Artificial Sequence
  Description of Artificial Sequence: Synthetic peptide
RASEGVYSYMH

SEQ ID NO: 460 - protein, 7 aa, Artificial Sequence
  Description of Artificial Sequence: Synthetic peptide
KASNLAS

SEQ ID NO: 461 - protein, 9 aa, Artificial Sequence
  Description of Artificial Sequence: Synthetic peptide
HQNWNDPLT

SEQ ID NO: 462 - protein, 123 aa, Artificial Sequence
  Description of Artificial Sequence: Synthetic polypeptide
QVQLEQSGAELVKPGTSVKLSCMASGYTSSSNHMNWMKQTTGQGLEWIGIINPGSGGTRYNVKFEGKATLTVDKSSSTAFMQLNSLTPEDSAVYYCARAGFPGPFSYYAMGAWGQGTSVTVSS

SEQ ID NO: 463 - protein, 10 aa, Artificial Sequence
  Description of Artificial Sequence: Synthetic peptide
GYTSSSNHMN

SEQ ID NO: 464 - protein, 17 aa, Artificial Sequence
  Description of Artificial Sequence: Synthetic peptide
IINPGSGGTRYNVKFEG

SEQ ID NO: 465 - protein, 14 aa, Artificial Sequence
  Description of Artificial Sequence: Synthetic peptide
AGFPGPFSYYAMGA

SEQ ID NO: 466 - protein, 106 aa, Artificial Sequence
  Description of Artificial Sequence: Synthetic polypeptide
DIQMTQSPPVLSASVGDRVTLSCKASQNIHNNLDWYQQKHGEAPKLLIFYTNNLQTGIPSRFSGSGSGTDYTLTISSLQPEDVATYYCYQYNSGYTFGAGTKLELK

SEQ ID NO: 467 - protein, 11 aa, Artificial Sequence
  Description of Artificial Sequence: Synthetic peptide
KASQNIHNNLD

SEQ ID NO: 468 - protein, 7 aa, Artificial Sequence
  Description of Artificial Sequence: Synthetic peptide
YTNNLQT

SEQ ID NO: 469 - protein, 8 aa, Artificial Sequence
  Description of Artificial Sequence: Synthetic peptide
YQYNSGYT

SEQ ID NO: 470 - protein, 118 aa, Artificial Sequence
  Description of Artificial Sequence: Synthetic polypeptide
QIQLVQSGPELKKPGESVKISCKASGYTFTNYGVYWVKQAPGQGLQYMGWINTETGKPTYADDFKGRFVFFLETSTNTAYLQINNLKNEDMATFFCARARQLDWFVYWGQGTLVTVSS

SEQ ID NO: 471 - protein, 10 aa, Artificial Sequence
  Description of Artificial Sequence: Synthetic peptide
GYTFTNYGVY

SEQ ID NO: 472 - protein, 17 aa, Artificial Sequence
  Description of Artificial Sequence: Synthetic peptide
WINTETGKPTYADDFKG

SEQ ID NO: 473 - protein, 9 aa, Artificial Sequence
  Description of Artificial Sequence: Synthetic peptide
ARQLDWFVY

SEQ ID NO: 474 - protein, 106 aa, Artificial Sequence
  Description of Artificial Sequence: Synthetic polypeptide
DTVLTQSPALTVSPGERVSISCRARESLTTSLCWFQQKPGQQPKLLIYGASKLESGVPARFSGSGSGTDFTLTIDPVEADDTATYFCQQSWYDPPTFGGGTKLELK

SEQ ID NO: 475 - protein, 11 aa, Artificial Sequence
  Description of Artificial Sequence: Synthetic peptide
RARESLTTSLC

SEQ ID NO: 476 - protein, 7 aa, Artificial Sequence
  Description of Artificial Sequence: Synthetic peptide
GASKLES

SEQ ID NO: 477 - protein, 9 aa, Artificial Sequence
  Description of Artificial Sequence: Synthetic peptide
QQSWYDPPT

SEQ ID NO: 478 - protein, 116 aa, Artificial Sequence
  Description of Artificial Sequence: Synthetic polypeptide
EVQLVESGGGLVQPGSSLKLSCAASGFTFSYYGMHWIRQAPKKGLEWMALIYYDSSKMYYADSVKGRFTISRDNSKNTLYLEMNSLRSEDTAMYYCAAGGTAPVYWGQGVMVTVSS

SEQ ID NO: 479 - protein, 10 aa, Artificial Sequence
  Description of Artificial Sequence: Synthetic peptide
GFTFSYYGMH

SEQ ID NO: 480 - protein, 17 aa, Artificial Sequence
  Description of Artificial Sequence: Synthetic peptide
LIYYDSSKMYYADSVKG

SEQ ID NO: 481 - protein, 7 aa, Artificial Sequence
  Description of Artificial Sequence: Synthetic peptide
GGTAPVY

SEQ ID NO: 482 - protein, 106 aa, Artificial Sequence
  Description of Artificial Sequence: Synthetic polypeptide
NIQLTQSPSLLSASVGDRVTLSCKGSQNIANYLAWYQQKLGEAPKLLIYNTDSLQTGIPSRFSGSGSGTDYTLTISSLQPEDVATYFCYQSNNGYTFGAGTKLELR

SEQ ID NO: 483 - protein, 11 aa, Artificial Sequence
  Description of Artificial Sequence: Synthetic peptide
KGSQNIANYLA

SEQ ID NO: 484 - protein, 7 aa, Artificial Sequence
  Description of Artificial Sequence: Synthetic peptide
NTDSLQT

SEQ ID NO: 485 - protein, 8 aa, Artificial Sequence
  Description of Artificial Sequence: Synthetic peptide
YQSNNGYT

SEQ ID NO: 486 - protein, 121 aa, Artificial Sequence
  Description of Artificial Sequence: Synthetic polypeptide
QIQLVQSGPELKKPGESVKISCKASGYTFTDYAMHWVKQAPGKVLKWMGWINTFTGKPTYIDDFKGRFVFSLEASASTANLQISDLKNEDTATYFCARGNYYSGYWYFDFWGPGTMVTMSS

SEQ ID NO: 487 - protein, 10 aa, Artificial Sequence
  Description of Artificial Sequence: Synthetic peptide
GYTFTDYAMH

SEQ ID NO: 488 - protein, 17 aa, Artificial Sequence
  Description of Artificial Sequence: Synthetic peptide
WINTFTGKPTYIDDFKG

SEQ ID NO: 489 - protein, 12 aa, Artificial Sequence
  Description of Artificial Sequence: Synthetic peptide
GNYYSGYWYFDF

SEQ ID NO: 490 - protein, 106 aa, Artificial Sequence
  Description of Artificial Sequence: Synthetic polypeptide
DIQMTQSPASLSASLGETISIECRASEDISSNLAWYQQKSGKSPQLLIFAANRLQDGVPSRFSGSGSGTQFSLKISGMQPEDEGDYFCLQGSKFYTFGAGTKLELK

SEQ ID NO: 491 - protein, 11 aa, Artificial Sequence
  Description of Artificial Sequence: Synthetic peptide
RASEDISSNLA

SEQ ID NO: 492 - protein, 7 aa, Artificial Sequence
  Description of Artificial Sequence: Synthetic peptide
AANRLQD

SEQ ID NO: 493 - protein, 8 aa, Artificial Sequence
  Description of Artificial Sequence: Synthetic peptide
LQGSKFYT

SEQ ID NO: 494 - protein, 120 aa, Artificial Sequence
  Description of Artificial Sequence: Synthetic polypeptide
QIQLVQSGPELKKPGESVKISCKASGYTFTNYGMYWVKQAPGQGLQYMGWINTETGKPIYADDFKGRFVFFLETSASTAYLQINNLKNEDMATFFCARVDYDGSFWFAYWGQGTLVTVSS

SEQ ID NO: 495 - protein, 10 aa, Artificial Sequence
  Description of Artificial Sequence: Synthetic peptide
GYTFTNYGMY

SEQ ID NO: 496 - protein, 17 aa, Artificial Sequence
  Description of Artificial Sequence: Synthetic peptide
WINTETGKPIYADDFKG

SEQ ID NO: 497 - protein, 11 aa, Artificial Sequence
  Description of Artificial Sequence: Synthetic peptide
VDYDGSFWFAY

SEQ ID NO: 498 - protein, 106 aa, Artificial Sequence
  Description of Artificial Sequence: Synthetic polypeptide
DTVLTQSPALAVSPGERVSISCRASESVSTVIHWYQQKPGQQPKLLIHGASNLESGVPARFSGSGSGTDFTLTIDPVEADDTATYFCQQHWNDPPTFGAGTKLEMK

SEQ ID NO: 499 - protein, 11 aa, Artificial Sequence
  Description of Artificial Sequence: Synthetic peptide
RASESVSTVIH

SEQ ID NO: 500 - protein, 7 aa, Artificial Sequence
  Description of Artificial Sequence: Synthetic peptide
GASNLES

SEQ ID NO: 501 - protein, 9 aa, Artificial Sequence
  Description of Artificial Sequence: Synthetic peptide
QQHWNDPPT

SEQ ID NO: 502 - protein, 121 aa, Artificial Sequence
  Description of Artificial Sequence: Synthetic polypeptide
QIQLVQSGPELKKPGESVKVSCKASGYTFTNYGIHWVKQAPGQGLQYVGWINTETGRPTYADDFKGRFVFFLETSASTAYLQINNLKNEDMATYFCARPLYYGYAHYFDYWGQGVMVTVSS

SEQ ID NO: 503 - protein, 10 aa, Artificial Sequence
  Description of Artificial Sequence: Synthetic peptide
GYTFTNYGIH

SEQ ID NO: 504 - protein, 17 aa, Artificial Sequence
  Description of Artificial Sequence: Synthetic peptide
WINTETGRPTYADDFKG

SEQ ID NO: 505 - protein, 12 aa, Artificial Sequence
  Description of Artificial Sequence: Synthetic peptide
PLYYGYAHYFDY

SEQ ID NO: 506 - protein, 107 aa, Artificial Sequence
  Description of Artificial Sequence: Synthetic polypeptide
DIQMTQSPASLSASLEEIVTITCQASQDIGNWLAWYQQKPGKSPQLLIYGATSLADGVPSRFSGSRSGTQYSLKISRLQVEDIGIYYCQQASSVTYTFGAGTKLELK

SEQ ID NO: 507 - protein, 11 aa, Artificial Sequence
  Description of Artificial Sequence: Synthetic peptide
QASQDIGNWLA

SEQ ID NO: 508 - protein, 7 aa, Artificial Sequence
  Description of Artificial Sequence: Synthetic peptide
GATSLAD

SEQ ID NO: 509 - protein, 9 aa, Artificial Sequence
  Description of Artificial Sequence: Synthetic peptide
QQASSVTYT

SEQ ID NO: 510 - protein, 121 aa, Artificial Sequence
  Description of Artificial Sequence: Synthetic polypeptide
QIQLVQSGPELKKPGESVKISCKASGYTFTNYGMYWVKLAPGQGLQYLGWINTETGKPTYADDFKGRFVFFLETSASTAYLQINNLRNEDMATYFCARPSDYYDGFWFAYWGQGTLVTVSS

SEQ ID NO: 511 - protein, 10 aa, Artificial Sequence
  Description of Artificial Sequence: Synthetic peptide
GYTFTNYGMY

SEQ ID NO: 512 - protein, 17 aa, Artificial Sequence
  Description of Artificial Sequence: Synthetic peptide
WINTETGKPTYADDFKG

SEQ ID NO: 513 - protein, 12 aa, Artificial Sequence
  Description of Artificial Sequence: Synthetic peptide
PSDYYDGFWFAY

SEQ ID NO: 514 - protein, 106 aa, Artificial Sequence
  Description of Artificial Sequence: Synthetic polypeptide
DTVLTQSPALTVSPGERVSISCRASEWVNSYMHWYQQNPGQQPKLLIYKASNLASGVPARFSGSGSGTDFTLTLDPVEADDTATYFCQQSWNDPLTFGSGTKLEIK

SEQ ID NO: 515 - protein, 11 aa, Artificial Sequence
  Description of Artificial Sequence: Synthetic peptide
RASEWVNSYMH

SEQ ID NO: 516 - protein, 7 aa, Artificial Sequence
  Description of Artificial Sequence: Synthetic peptide
KASNLAS

SEQ ID NO: 517 - protein, 9 aa, Artificial Sequence
  Description of Artificial Sequence: Synthetic peptide
QQSWNDPLT

SEQ ID NO: 518 - protein, 124 aa, Artificial Sequence
  Description of Artificial Sequence: Synthetic polypeptide
QIQLLQSGPELKKPGESVKISCKASGYTFTNYGMYWVKQAPGQGLQYMGWIDTETGRPTYADDFKGRFVFFLETSASTAYLQINNLKNEDMATYFCARWSGDTTGIRGPWFAYWGQGTLVTVSS

SEQ ID NO: 519 - protein, 10 aa, Artificial Sequence
  Description of Artificial Sequence: Synthetic peptide
GYTFTNYGMY

SEQ ID NO: 520 - protein, 17 aa, Artificial Sequence
  Description of Artificial Sequence: Synthetic peptide
WIDTETGRPTYADDFKG

SEQ ID NO: 521 - protein, 15 aa, Artificial Sequence
  Description of Artificial Sequence: Synthetic peptide
WSGDTTGIRGPWFAY

SEQ ID NO: 522 - protein, 107 aa, Artificial Sequence
  Description of Artificial Sequence: Synthetic polypeptide
DIRMTQSPASLSASLGETVNIECLASEDIYSDLAWYQQKPGRSPQLLIYNANGLQNGVPSRFGGSGSGTQYSLKINSLQSEDVATYFCQQYNYFPGTFGAGTKLELK

SEQ ID NO: 523 - protein, 11 aa, Artificial Sequence
  Description of Artificial Sequence: Synthetic peptide
LASEDIYSDLA

SEQ ID NO: 524 - protein, 7 aa, Artificial Sequence
  Description of Artificial Sequence: Synthetic peptide
NANGLQN

SEQ ID NO: 525 - protein, 9 aa, Artificial Sequence
  Description of Artificial Sequence: Synthetic peptide
QQYNYFPGT

SEQ ID NO: 526 - protein, 121 aa, Artificial Sequence
  Description of Artificial Sequence: Synthetic polypeptide
QIQLVQSGPELKKPGESVKISCKASGYTFTNYGMYWVKQAPGQGLQYMGWINTETGKPTYADDFKGRFVFFLETSASTAFLQINNLKNEDMATYFCARPSDYYDGFWFPYWGQGALVTVSS

SEQ ID NO: 527 - protein, 10 aa, Artificial Sequence
  Description of Artificial Sequence: Synthetic peptide
GYTFTNYGMY

SEQ ID NO: 528 - protein, 17 aa, Artificial Sequence
  Description of Artificial Sequence: Synthetic peptide
WINTETGKPTYADDFKG

SEQ ID NO: 529 - protein, 12 aa, Artificial Sequence
  Description of Artificial Sequence: Synthetic peptide
PSDYYDGFWFPY

SEQ ID NO: 530 - protein, 106 aa, Artificial Sequence
  Description of Artificial Sequence: Synthetic polypeptide
DTILTQSPALAVSPGERISISCRASEGVNSYMHWYQQNPGQQPKLLIYKASNLASGVPARFSGSGSGTDFTLTIDPVEADDTATYFCQQSWNDPLTFGSGTKLEIK

SEQ ID NO: 531 - protein, 11 aa, Artificial Sequence
  Description of Artificial Sequence: Synthetic peptide
RASEGVNSYMH

SEQ ID NO: 532 - protein, 7 aa, Artificial Sequence
  Description of Artificial Sequence: Synthetic peptide
KASNLAS

SEQ ID NO: 533 - protein, 9 aa, Artificial Sequence
  Description of Artificial Sequence: Synthetic peptide
QQSWNDPLT

SEQ ID NO: 534 - protein, 123 aa, Artificial Sequence
  Description of Artificial Sequence: Synthetic polypeptide
QIQLVQSGPELKKPGESVKISCKASGYTFTNYGMYWVKQAPGQGLQYMGWIDTETGKPTYADDFKGRFVFFLETSASTAYLQINNLRNEDMATYFCARWGYTSDYYYGWFPDWGQGTLVTVST

SEQ ID NO: 535 - protein, 10 aa, Artificial Sequence
  Description of Artificial Sequence: Synthetic peptide
GYTFTNYGMY

SEQ ID NO: 536 - protein, 17 aa, Artificial Sequence
  Description of Artificial Sequence: Synthetic peptide
WIDTETGKPTYADDFKG

SEQ ID NO: 537 - protein, 14 aa, Artificial Sequence
  Description of Artificial Sequence: Synthetic peptide
WGYTSDYYYGWFPD

SEQ ID NO: 538 - protein, 106 aa, Artificial Sequence
  Description of Artificial Sequence: Synthetic polypeptide
DTVLTQSPALAVSPGERVSISCRASEGVNSYMHWYQQNPGQQPKLLIYKASNLASGVPARFSGSGSGTDFTLNIHPVEADDTATYFCQQNWNVPLTFGSGTKLEIK

SEQ ID NO: 539 - protein, 11 aa, Artificial Sequence
  Description of Artificial Sequence: Synthetic peptide
RASEGVNSYMH

SEQ ID NO: 540 - protein, 7 aa, Artificial Sequence
  Description of Artificial Sequence: Synthetic peptide
KASNLAS

SEQ ID NO: 541 - protein, 9 aa, Artificial Sequence
  Description of Artificial Sequence: Synthetic peptide
QQNWNVPLT

SEQ ID NO: 542 - protein, 123 aa, Artificial Sequence
  Description of Artificial Sequence: Synthetic polypeptide
EVKLQQSGDELVRPGASVKMSCKASGYTFTDYVMHWVKQSPGQGLEWIGTIIPLIDTTSYNQKFKGKATLTADKSSNTAYMELSRLTSEDSAVYYCARTSPYYYSSYDVMDAWGQGASVTVSS

SEQ ID NO: 543 - protein, 10 aa, Artificial Sequence
  Description of Artificial Sequence: Synthetic peptide
GYTFTDYVMH

SEQ ID NO: 544 - protein, 17 aa, Artificial Sequence
  Description of Artificial Sequence: Synthetic peptide
TIIPLIDTTSYNQKFKG

SEQ ID NO: 545 - protein, 14 aa, Artificial Sequence
  Description of Artificial Sequence: Synthetic peptide
TSPYYYSSYDVMDA

SEQ ID NO: 546 - protein, 106 aa, Artificial Sequence
  Description of Artificial Sequence: Synthetic polypeptide
NIQLTQSPSLLSASVGDRVTLSCKGSQNINNYLAWYQQKLGEAPKLLIYKTNNLQTGIPSRFSGCGSGTDYTLTISSLHSEDLATYYCYQYDNGYTFGAGTKLELK

SEQ ID NO: 547 - protein, 11 aa, Artificial Sequence
  Description of Artificial Sequence: Synthetic peptide
KGSQNINNYLA

SEQ ID NO: 548 - protein, 7 aa, Artificial Sequence
  Description of Artificial Sequence: Synthetic peptide
KTNNLQT

SEQ ID NO: 549 - protein, 8 aa, Artificial Sequence
  Description of Artificial Sequence: Synthetic peptide
YQYDNGYT

SEQ ID NO: 550 - protein, 123 aa, Artificial Sequence
  Description of Artificial Sequence: Synthetic polypeptide
QVTLKESGPGILQPSQTLSLTCTFSGFSLSTFGMGVGWIRQPSGKGLEWLANIWWDDDKYYNPSLKNRLTISKDTSNSQAFLEITNVDTADTATYYCARISTGISSYYVMDAWGQGASVTVSS

SEQ ID NO: 551 - protein, 12 aa, Artificial Sequence
  Description of Artificial Sequence: Synthetic peptide
GFSLSTFGMGVG

SEQ ID NO: 552 - protein, 16 aa, Artificial Sequence
  Description of Artificial Sequence: Synthetic peptide
NIWWDDDKYYNPSLKN

SEQ ID NO: 553 - protein, 13 aa, Artificial Sequence
  Description of Artificial Sequence: Synthetic peptide
ISTGISSYYVMDA

SEQ ID NO: 554 - protein, 111 aa, Artificial Sequence
  Description of Artificial Sequence: Synthetic polypeptide
QFTLTQPKSVSGSLRSTITIPCERSSGDIGDTYVSWYQQHLGRPPINVIYGNDQRPSEVSDRFSGSIDSSSNSASLTITNLQMDDEADYFCQSYDSDIDIVFGGGTKLTVL

SEQ ID NO: 555 - protein, 13 aa, Artificial Sequence
  Description of Artificial Sequence: Synthetic peptide
ERSSGDIGDTYVS

SEQ ID NO: 556 - protein, 7 aa, Artificial Sequence
  Description of Artificial Sequence: Synthetic peptide
GNDQRPS

SEQ ID NO: 557 - protein, 10 aa, Artificial Sequence
  Description of Artificial Sequence: Synthetic peptide
QSYDSDIDIV

SEQ ID NO: 558 - protein, 123 aa, Artificial Sequence; identical to SEQ ID NO: 550
  Description of Artificial Sequence: Synthetic polypeptide

SEQ ID NO: 559 - protein, 12 aa, Artificial Sequence
  Description of Artificial Sequence: Synthetic peptide
GFSLSTFGMGVG

SEQ ID NO: 560 - protein, 16 aa, Artificial Sequence
  Description of Artificial Sequence: Synthetic peptide
NIWWDDDKYYNPSLKN

SEQ ID NO: 561 - protein, 13 aa, Artificial Sequence
  Description of Artificial Sequence: Synthetic peptide
ISTGISSYYVMDA

SEQ ID NO: 562 - protein, 111 aa, Artificial Sequence; identical to SEQ ID NO: 554
  Description of Artificial Sequence: Synthetic polypeptide

SEQ ID NO: 563 - protein, 13 aa, Artificial Sequence
  Description of Artificial Sequence: Synthetic peptide
ERSSGDIGDTYVS

SEQ ID NO: 564 - protein, 7 aa, Artificial Sequence
  Description of Artificial Sequence: Synthetic peptide
GNDQRPS

SEQ ID NO: 565 - protein, 10 aa, Artificial Sequence
  Description of Artificial Sequence: Synthetic peptide
QSYDSDIDIV

SEQ ID NO: 566 - protein, 124 aa, Artificial Sequence
  Description of Artificial Sequence: Synthetic polypeptide
EVQLVESGGGLVQPGRSLKFSCAASGFSFSDSAMAWVRQAPKKGLEWVATIIYDGSGTYYRDSVKGRFTISRDNAKSTLYLQMDSLRSEDTATYYCARLGFNYGNYGYYVMDAWGQGASVTVSS

SEQ ID NO: 567 - protein, 10 aa, Artificial Sequence
  Description of Artificial Sequence: Synthetic peptide
GFSFSDSAMA

SEQ ID NO: 568 - protein, 17 aa, Artificial Sequence
  Description of Artificial Sequence: Synthetic peptide
TIIYDGSGTYYRDSVKG

SEQ ID NO: 569 - protein, 15 aa, Artificial Sequence
  Description of Artificial Sequence: Synthetic peptide
LGFNYGNYGYYVMDA

SEQ ID NO: 570 - protein, 113 aa, Artificial Sequence
  Description of Artificial Sequence: Synthetic polypeptide
QFTLTQPKSVSGSLRNTITIPCERSSGDIGDSYVSWYQQHLGRPPINVIFADDQRPSEVSDRFSGSIDSSSNSASLTITNLQMDDEADYFCQSYDSNIDINIVFGGGTKLTVL

SEQ ID NO: 571 - protein, 13 aa, Artificial Sequence
  Description of Artificial Sequence: Synthetic peptide
ERSSGDIGDSYVS

SEQ ID NO: 572 - protein, 7 aa, Artificial Sequence
  Description of Artificial Sequence: Synthetic peptide
ADDQRPS

SEQ ID NO: 573 - protein, 12 aa, Artificial Sequence
  Description of Artificial Sequence: Synthetic peptide
QSYDSNIDINIV

SEQ ID NO: 574 - protein, 120 aa, Artificial Sequence
  Description of Artificial Sequence: Synthetic polypeptide
EVKLQQSGDELVRPGASVKMSCKASGYTFTDYAMHWVKQSPGQGLEWIGTIIPLIDTTSYNQKFKGKATLTADTSSNTAYMELSRLTSEDSAVYYCARDWDNNWGYFDYWGQGVMVTVSS

SEQ ID NO: 575 - protein, 10 aa, Artificial Sequence
  Description of Artificial Sequence: Synthetic peptide
GYTFTDYAMH

SEQ ID NO: 576 - protein, 17 aa, Artificial Sequence
  Description of Artificial Sequence: Synthetic peptide
TIIPLIDTTSYNQKFKG

SEQ ID NO: 577 - protein, 11 aa, Artificial Sequence
  Description of Artificial Sequence: Synthetic peptide
DWDNNWGYFDY

SEQ ID NO: 578 - protein, 112 aa, Artificial Sequence
  Description of Artificial Sequence: Synthetic polypeptide
DVVLTQTPVSLSVTLGDQASISCRSSQSLEYSDGYTYLEWYLQKPGQSPQLLIYGVSNRFSGVPDRFIGSGSGTDFTLKISRVEPEDLGVYYCFQATHDPLTFGSGTKLEIK

SEQ ID NO: 579 - protein, 16 aa, Artificial Sequence
  Description of Artificial Sequence: Synthetic peptide
RSSQSLEYSDGYTYLE

SEQ ID NO: 580 - protein, 7 aa, Artificial Sequence
  Description of Artificial Sequence: Synthetic peptide
GVSNRFS

SEQ ID NO: 581 - protein, 9 aa, Artificial Sequence
  Description of Artificial Sequence: Synthetic peptide
FQATHDPLT

SEQ ID NO: 582 - protein, 122 aa, Artificial Sequence
  Description of Artificial Sequence: Synthetic polypeptide
QVTLKESGPGILQPSQTLSLTCTFSGFSLSTYGMGVGWIRQPSGKGLEWLANIWWDDDKYYNPSLKNRLTISKDTSNNQAFLKITNVDTADTATYYCARIESIGTTYSFDYWGQGVMVTVSS

SEQ ID NO: 583 - protein, 12 aa, Artificial Sequence
  Description of Artificial Sequence: Synthetic peptide
GFSLSTYGMGVG

SEQ ID NO: 584 - protein, 16 aa, Artificial Sequence
  Description of Artificial Sequence: Synthetic peptide
NIWWDDDKYYNPSLKN

SEQ ID NO: 585 - protein, 12 aa, Artificial Sequence
  Description of Artificial Sequence: Synthetic peptide
IESIGTTYSFDY

SEQ ID NO: 586 - protein, 111 aa, Artificial Sequence
  Description of Artificial Sequence: Synthetic polypeptide
QFTLTQPKSVSGSLRSTITIPCERSSGDIGDSYVSWYQQHLGRPPINVIYADDQRPSEVSDRFSGSIDSSSNSASLTITNLQMDDEADYFCQSYDINIDIVFGGGTKLTVL

SEQ ID NO: 587 - protein, 13 aa, Artificial Sequence
  Description of Artificial Sequence: Synthetic peptide
ERSSGDIGDSYVS

SEQ ID NO: 588 - protein, 7 aa, Artificial Sequence
  Description of Artificial Sequence: Synthetic peptide
ADDQRPS

SEQ ID NO: 589 - protein, 10 aa, Artificial Sequence
  Description of Artificial Sequence: Synthetic peptide
QSYDINIDIV

SEQ ID NO: 590 - protein, 121 aa, Artificial Sequence
  Description of Artificial Sequence: Synthetic polypeptide
EVQLQQSGPELQRPGASVKLSCKASGYTFTESYIYWVKQRPEQSLELIGRIDPEDGSTDYVEKFKNKATLTADTSSNTAYMQLSSLTSEDTATYFCARFGARSYFYPMDAWGQGTSVTVSS

SEQ ID NO: 591 - protein, 10 aa, Artificial Sequence
  Description of Artificial Sequence: Synthetic peptide
GYTFTESYIY

SEQ ID NO: 592 - protein, 17 aa, Artificial Sequence
  Description of Artificial Sequence: Synthetic peptide
RIDPEDGSTDYVEKFKN

SEQ ID NO: 593 - protein, 12 aa, Artificial Sequence
  Description of Artificial Sequence: Synthetic peptide
FGARSYFYPMDA

SEQ ID NO: 594 - protein, 106 aa, Artificial Sequence
  Description of Artificial Sequence: Synthetic polypeptide
DTVLTQSPTLAVSPGERVSIPCRASESVSTLMHWYQQKPGQQPRLLIYGASNLESGVPARFSGSGSGTDFTLTIDPVEADDTATYFCQQSWNDPWTFGGGTKLELK

SEQ ID NO: 595 - protein, 11 aa, Artificial Sequence
  Description of Artificial Sequence: Synthetic peptide
RASESVSTLMH

SEQ ID NO: 596 - protein, 7 aa, Artificial Sequence
  Description of Artificial Sequence: Synthetic peptide
GASNLES

SEQ ID NO: 597 - protein, 9 aa, Artificial Sequence
  Description of Artificial Sequence: Synthetic peptide
QQSWNDPWT

SEQ ID NO: 598 - protein, 121 aa, Artificial Sequence
  Description of Artificial Sequence: Synthetic polypeptide
EVQLQQSGPELQRPGASVKLSCKASGYTFTESYMYWVKQRPEQSLELIGRIDPEDGSTDYVEKFKNKATLTADTSSNTAYMQLSSLTSEDSATYFCARFGARSYFYPMDAWGQGTSVTVSS

SEQ ID NO: 599 - protein, 10 aa, Artificial Sequence
  Description of Artificial Sequence: Synthetic peptide
GYTFTESYMY

SEQ ID NO: 600 - protein, 17 aa, Artificial Sequence
  Description of Artificial Sequence: Synthetic peptide
RIDPEDGSTDYVEKFKN

SEQ ID NO: 601 - protein, 12 aa, Artificial Sequence
  Description of Artificial Sequence: Synthetic peptide
FGARSYFYPMDA

SEQ ID NO: 602 - protein, 106 aa, Artificial Sequence
  Description of Artificial Sequence: Synthetic polypeptide
DTVLTQPPALAVSPGERVSISCRASESVSTLMHWYQQKPGQQPRLLIYGASNLESGVPARFSGSGSGTDFTLTIDPVEADDTATYFCQQSWNDPWTFGGGTKLELK

SEQ ID NO: 603 - protein, 11 aa, Artificial Sequence
  Description of Artificial Sequence: Synthetic peptide
RASESVSTLMH

SEQ ID NO: 604 - protein, 7 aa, Artificial Sequence
  Description of Artificial Sequence: Synthetic peptide
GASNLES

SEQ ID NO: 605 - protein, 9 aa, Artificial Sequence
  Description of Artificial Sequence: Synthetic peptide
QQSWNDPWT

SEQ ID NO: 606 - protein, 123 aa, Artificial Sequence
  Description of Artificial Sequence: Synthetic polypeptide
QIQLVQSGPELKKPGESVKISCKASEYTFTDYAIHWVKQAPGKGLKWMGWINTYTGKPTYADDFKGRFVFSLEASASTANLQISNLKNEDTATYFCARDYGGYGERRDYFDYWGQGVMVTVSS

SEQ ID NO: 607 - protein, 10 aa, Artificial Sequence
  Description of Artificial Sequence: Synthetic peptide
EYTFTDYAIH

SEQ ID NO: 608 - protein, 17 aa, Artificial Sequence
  Description of Artificial Sequence: Synthetic peptide
WINTYTGKPTYADDFKG

SEQ ID NO: 609 - protein, 14 aa, Artificial Sequence
  Description of Artificial Sequence: Synthetic peptide
DYGGYGERRDYFDY

SEQ ID NO: 610 - protein, 107 aa, Artificial Sequence
  Description of Artificial Sequence: Synthetic polypeptide
DIQMTQSPASLSASLGETVTIECRVSEDIYNGLAWYQQKPGKSPQFLIYNANRLHTGVPSRFSGSGSGTQFSLKINSLQSEDVANYFCQQYYDYPLTFGSATKLEIK

SEQ ID NO: 611 - protein, 11 aa, Artificial Sequence
  Description of Artificial Sequence: Synthetic peptide
RVSEDIYNGLA

SEQ ID NO: 612 - protein, 7 aa, Artificial Sequence
  Description of Artificial Sequence: Synthetic peptide
NANRLHT

SEQ ID NO: 613 - protein, 9 aa, Artificial Sequence
  Description of Artificial Sequence: Synthetic peptide
QQYYDYPLT

SEQ ID NO: 614 - protein, 120 aa, Artificial Sequence
  Description of Artificial Sequence: Synthetic polypeptide
QIQLVQSGPELKKPGESVKISCKASGYTFTNYGMYWVKQAPGQALQFMGWINTETGQPTYADDFKGRFVFFLETSASTAYLQINNLKNEDMATYFCARLGNNYGIWFAYWGQGTLVTVSS

SEQ ID NO: 615 - protein, 10 aa, Artificial Sequence
  Description of Artificial Sequence: Synthetic peptide
GYTFTNYGMY

SEQ ID NO: 616 - protein, 17 aa, Artificial Sequence
  Description of Artificial Sequence: Synthetic peptide
WINTETGQPTYADDFKG

SEQ ID NO: 617 - protein, 11 aa, Artificial Sequence
  Description of Artificial Sequence: Synthetic peptide
LGNNYGIWFAY

SEQ ID NO: 618 - protein, 107 aa, Artificial Sequence
  Description of Artificial Sequence: Synthetic polypeptide
DIQMTQSPASLSASLGETVTIECRASDDLYSTLAWYQQKPGDSPQLLIFDANRLAAGVPSRFSGSGSGTQYSLKINSLQSEDVASYFCQQYNKFPWTFGGGTKLELK

SEQ ID NO: 619 - protein, 11 aa, Artificial Sequence
  Description of Artificial Sequence: Synthetic peptide
RASDDLYSTLA

SEQ ID NO: 620 - protein, 7 aa, Artificial Sequence
  Description of Artificial Sequence: Synthetic peptide
DANRLAA

SEQ ID NO: 621 - protein, 9 aa, Artificial Sequence
  Description of Artificial Sequence: Synthetic peptide
QQYNKFPWT

SEQ ID NO: 622 - protein, 119 aa, Artificial Sequence
  Description of Artificial Sequence: Synthetic polypeptide
EVQLVESGGGLVQPRGSLKLSCAASGFDFNSYGMSWVRQAPGKGLDLVADISSKSYNYATYYADSVKDRFTISRDDSQSMVYLQMDNLKTEDTALYYCTESLELGGAYWGQGTLVTVSS

SEQ ID NO: 623 - protein, 10 aa, Artificial Sequence
  Description of Artificial Sequence: Synthetic peptide
GFDFNSYGMS

SEQ ID NO: 624 - protein, 19 aa, Artificial Sequence
  Description of Artificial Sequence: Synthetic peptide
DISSKSYNYATYYADSVKD

SEQ ID NO: 625 - protein, 8 aa, Artificial Sequence
  Description of Artificial Sequence: Synthetic peptide
SLELGGAY

SEQ ID NO: 626 - protein, 107 aa, Artificial Sequence
  Description of Artificial Sequence: Synthetic polypeptide
DIQMTQSPPSLSASLGDEVTITCQASQNINKFIAWYQQKPGKAPRLLIRYTSTLKSGTPSRFSGSGSGRDYSFSISNVESEDIASYYCLQYDSLPWTFGGGTKLELK

SEQ ID NO: 627 - protein, 11 aa, Artificial Sequence
  Description of Artificial Sequence: Synthetic peptide
QASQNINKFIA

SEQ ID NO: 628 - protein, 7 aa, Artificial Sequence
  Description of Artificial Sequence: Synthetic peptide
YTSTLKS

SEQ ID NO: 629 - protein, 9 aa, Artificial Sequence
  Description of Artificial Sequence: Synthetic peptide
LQYDSLPWT

SEQ ID NO: 630 - protein, 119 aa, Artificial Sequence
  Description of Artificial Sequence: Synthetic polypeptide
EVQLVESGGGLVQPGRSLKLSCAASGFTFSNYGMAWVRQAPTQGLEWVASITNSGGNTYYRDSVKGRFTISRDSAKNTQYLQMDSLRSEDTATYFCARHTPGANYFDYWGQGLMVTVSS

SEQ ID NO: 631 - protein, 10 aa, Artificial Sequence
  Description of Artificial Sequence: Synthetic peptide
GFTFSNYGMA

SEQ ID NO: 632 - protein, 17 aa, Artificial Sequence
  Description of Artificial Sequence: Synthetic peptide
SITNSGGNTYYRDSVKG

SEQ ID NO: 633 - protein, 10 aa, Artificial Sequence
  Description of Artificial Sequence: Synthetic peptide
HTPGANYFDY

SEQ ID NO: 634 - protein, 106 aa, Artificial Sequence
  Description of Artificial Sequence: Synthetic polypeptide
DIQMTQSPPSLSASLGEKVTITCQASQSIKNYIAWYQLKPGTAPRLLMRYTSTLESGTPSRFSGSGSGRDYSFSISNVESEDIASYYCVQYANLYTFGGGTKLELK

SEQ ID NO: 635 - protein, 11 aa, Artificial Sequence
  Description of Artificial Sequence: Synthetic peptide
QASQSIKNYIA

SEQ ID NO: 636 - protein, 7 aa, Artificial Sequence
  Description of Artificial Sequence: Synthetic peptide
YTSTLES

SEQ ID NO: 637 - protein, 8 aa, Artificial Sequence
  Description of Artificial Sequence: Synthetic peptide
VQYANLYT

SEQ ID NO: 638 - protein, 118 aa, Artificial Sequence
  Description of Artificial Sequence: Synthetic polypeptide
QVQLKESGPGLMQPSQTLSLTCTVSGFSLTNYGVSWVRQFPGKGLEWIAAISSGGSTYYNSALKSRLSISRDTSRSQVFLKMNSLLTEDTAFYFCTRVYYGSNYFDYWGPGVMVTVSS

SEQ ID NO: 639 - protein, 10 aa, Artificial Sequence
  Description of Artificial Sequence: Synthetic peptide
GFSLTNYGVS

SEQ ID NO: 640 - protein, 16 aa, Artificial Sequence
  Description of Artificial Sequence: Synthetic peptide
AISSGGSTYYNSALKS

SEQ ID NO: 641 - protein, 10 aa, Artificial Sequence
  Description of Artificial Sequence: Synthetic peptide
VYYGSNYFDY

SEQ ID NO: 642 - protein, 113 aa, Artificial Sequence
  Description of Artificial Sequence: Synthetic polypeptide
DIVMTQTPSSQAVSAGEKVTMSCKSSQSLLYGGDQKNFLAWYQQKPGQSPKLLIYLASTRESGVPDRFIGSGSGTDFTLTISSVQAEDLADYYCQQHYGYPFTFGSGTKLEIK

SEQ ID NO: 643 - protein, 17 aa, Artificial Sequence
  Description of Artificial Sequence: Synthetic peptide
KSSQSLLYGGDQKNFLA

SEQ ID NO: 644 - protein, 7 aa, Artificial Sequence
  Description of Artificial Sequence: Synthetic peptide
LASTRES

SEQ ID NO: 645 - protein, 9 aa, Artificial Sequence
  Description of Artificial Sequence: Synthetic peptide
QQHYGYPFT

SEQ ID NO: 646 - protein, 116 aa, Artificial Sequence
  Description of Artificial Sequence: Synthetic polypeptide
EVQLVESGGGLVQPGSSLKLSCLASGFTFSNYNMYWIRQAPKKGLEWIALIFYDNNNKYYADSVKGRFTISRDNSKNTLYLEMNSLRSEDTAMYYCLRDSGPFSYWGQGTLVTVSS

SEQ ID NO: 647 - protein, 10 aa, Artificial Sequence
  Description of Artificial Sequence: Synthetic peptide
GFTFSNYNMY

SEQ ID NO: 648 - protein, 17 aa, Artificial Sequence
  Description of Artificial Sequence: Synthetic peptide
LIFYDNNNKYYADSVKG

SEQ ID NO: 649 - protein, 7 aa, Artificial Sequence
  Description of Artificial Sequence: Synthetic peptide
DSGPFSY

SEQ ID NO: 650 - protein, 107 aa, Artificial Sequence
  Description of Artificial Sequence: Synthetic polypeptide
DIQMTQSPPSLSASLGDKVTINCQAGQNIKKYIAWYQQEPGKVPRLLIRYTSKLESDTPSRFSGSGSGRDYSFSISNVESEDIASYYCLQYDNLPWTFGGGTKLELK

SEQ ID NO: 651 - protein, 11 aa, Artificial Sequence
  Description of Artificial Sequence: Synthetic peptide
QAGQNIKKYIA

SEQ ID NO: 652 - protein, 7 aa, Artificial Sequence
  Description of Artificial Sequence: Synthetic peptide
YTSKLES

SEQ ID NO: 653 - protein, 9 aa, Artificial Sequence
  Description of Artificial Sequence: Synthetic peptide
LQYDNLPWT

SEQ ID NO: 654 - protein, 123 aa, Artificial Sequence
  Description of Artificial Sequence: Synthetic polypeptide
QVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 655 - protein, 123 aa, Artificial Sequence; identical to SEQ ID NO: 17
  Description of Artificial Sequence: Synthetic polypeptide

SEQ ID NO: 656 - protein, 123 aa, Artificial Sequence; identical to SEQ ID NO: 29
  Description of Artificial Sequence: Synthetic polypeptide

SEQ ID NO: 657 - protein, 123 aa, Artificial Sequence
  Description of Artificial Sequence: Synthetic polypeptide
EVQLVQSGSELKKPGASVKVSCKASGYTFTNYGMYWVRQAPGQGLEYMGWINTETGKPTYADDFKGRFVFSLDTSVSTAYLQISSLKAEDTAVYYCARTNYYYRSYIFYFDYWGQGTMVTVSS

SEQ ID NO: 658 - protein, 123 aa, Artificial Sequence
  Description of Artificial Sequence: Synthetic polypeptide
QVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARTNYYYRSYIFYFDYWGQGTMVTVSS

SEQ ID NO: 659 - protein, 123 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARTNYYYRSYIFYFDYWGQGTMVTVSS

SEQ ID NO: 660 - protein, 123 aa, Artificial Sequence; identical to SEQ ID NO: 33
  Description of Artificial Sequence: Synthetic polypeptide

SEQ ID NO: 661 - protein, 123 aa, Artificial Sequence
  Description of Artificial Sequence: Synthetic polypeptide
EVQLVQSGAEVKKPGASVKVSCKASGYTFTNYGMYWVRQAPGQGLEYMGWINTETGKPTYADDFKGRVTMTLDTSTSTAYMELRSLRSDDTAVYYCARTNYYYRSYIFYFDYWGQGTMVTVSS

SEQ ID NO: 662 - protein, 123 aa, Artificial Sequence; identical to SEQ ID NO: 19
  Description of Artificial Sequence: Synthetic polypeptide

SEQ ID NO: 663 - protein, 123 aa, Artificial Sequence; identical to SEQ ID NO: 21
  Description of Artificial Sequence: Synthetic polypeptide

SEQ ID NO: 664 - protein, 123 aa, Artificial Sequence; identical to SEQ ID NO: 23
  Description of Artificial Sequence: Synthetic polypeptide

SEQ ID NO: 665 - protein, 107 aa, Artificial Sequence; identical to SEQ ID NO: 30
  Description of Artificial Sequence: Synthetic polypeptide

SEQ ID NO: 666 - protein, 106 aa, Artificial Sequence; identical to SEQ ID NO: 28
  Description of Artificial Sequence: Synthetic polypeptide

SEQ ID NO: 667 - protein, 106 aa, Artificial Sequence
  Description of Artificial Sequence: Synthetic polypeptide
ATQLTQSPSLSASVGDRVTITCRASESVSTHMHWYQQKPGKAPKLLIYGASNLESGVPSRFSGSGSGTDFTLTISSLQPEDFATYYCQQSWNDPFTFGQGTKLEIK

SEQ ID NO: 668 - protein, 107 aa, Artificial Sequence
  Description of Artificial Sequence: Synthetic polypeptide
ATQLTQSPSSLSASVGDRVTITCRASESVSTHMHWYQQKPGKAPKLLIYGASNLESGVPSRFSGSGSGTDFTLTISSLQPEDFATYYCQQSWNDPFTFGQGTKLEIK

SEQ ID NO: 669 - protein, 107 aa, Artificial Sequence; identical to SEQ ID NO: 18
  Description of Artificial Sequence: Synthetic polypeptide

SEQ ID NO: 670 - protein, 107 aa, Artificial Sequence; identical to SEQ ID NO: 20
  Description of Artificial Sequence: Synthetic polypeptide

SEQ ID NO: 671 - protein, 107 aa, Artificial Sequence; identical to SEQ ID NO: 22
  Description of Artificial Sequence: Synthetic polypeptide

SEQ ID NO: 672 - protein, 107 aa, Artificial Sequence; identical to SEQ ID NO: 24
  Description of Artificial Sequence: Synthetic polypeptide

SEQ ID NO: 673 - protein, 120 aa, Artificial Sequence
  Description of Artificial Sequence: Synthetic polypeptide
QVQLVQSGHEVKQPGASVKVSCKASGYTFTNYGMYWVPQAPGQGLEWMGWINTETGKPIYADDFKGRFVFSMDTSASTAYLQISSLKAEDMAMYYCARVDYDGSFWFAYWGQGTLVTVSS

SEQ ID NO: 674 - protein, 120 aa, Artificial Sequence
  Description of Artificial Sequence: Synthetic polypeptide
EVQLVQSGHEVKQPGASVKVSCKASGYTFTNYGMYWVPQAPGQGLEWMGWINTETGKPIYADDFKGRFVFSMDTSASTAYLQISSLKAEDMAMYYCARVDYDGSFWFAYWGQGTLVTVSS

SEQ ID NO: 675 - protein, 120 aa, Artificial Sequence
  Description of Artificial Sequence: Synthetic polypeptide
EIQLVQSGHEVKQPGASVKVSCKASGYTFTNYGMYWVKQAPGQGLEYMGWINTETGKPIYADDFKGRFVFSLDTSASTAYLQISSLKAEDMAMFFCARVDYDGSFWFAYWGQGTLVTVSS

SEQ ID NO: 676 - protein, 120 aa, Artificial Sequence
  Description of Artificial Sequence: Synthetic polypeptide
EVQLVQSGHEVKQPGASVKVSCKASGYTFTNYGMYWVPQAPGQGLEYMGWINTETGKPIYADDFKGRFVFSLDTSASTAYLQISSLKAEDMAMFYCARVDYDGSFWFAYWGQGTLVTVSS

SEQ ID NO: 677 - protein, 120 aa, Artificial Sequence
  Description of Artificial Sequence: Synthetic polypeptide
EVQLVQSGHEVKQPGASVKVSCKASGYSFTNYGMYWVPQAPGQGLEYMGWINTETGKPIYADDFKGRFVFSLDTSASTAYLQISSLKAEDMAMFYCARVDYDGSFWFAYWGQGTLVTVSS

SEQ ID NO: 678 - protein, 120 aa, Artificial Sequence
  Description of Artificial Sequence: Synthetic polypeptide
QVQLVQSGAEVKKPGASVKVSCKASGYTFTNYGMYWVRQAPGQGLEWMGWINTETGKPIYADDFKGRVTMTTDTSTSTAYMELRSLRSDDTAVYYCARVDYDGSFWFAYWGQGTLVTVSS

SEQ ID NO: 679 - protein, 120 aa, Artificial Sequence; identical to SEQ ID NO: 25
  Description of Artificial Sequence: Synthetic polypeptide

SEQ ID NO: 680 - protein, 120 aa, Artificial Sequence
  Description of Artificial Sequence: Synthetic polypeptide
EIQLVQSGAEVKKPGASVKVSCKASGYTFTNYGMYWVKQAPGQGLEYMGWINTETGKPIYADDFKGRFTFTLDTSTSTAYMELRSLRSDDTAVFFCARVDYDGSFWFAYWGQGTLVTVSS

SEQ ID NO: 681 - protein, 120 aa, Artificial Sequence
  Description of Artificial Sequence: Synthetic polypeptide
EVQLVQSGAEVKKPGASVKVSCKASGYTFTNYGMYWVRQAPGQGLEYMGWINTETGKPIYADDFKGRVTMTLDTSTSTAYMELRSLRSDDTAVFYCARVDYDGSFWFAYWGQGTLVTVSS

SEQ ID NO: 682 - protein, 120 aa, Artificial Sequence
  Description of Artificial Sequence: Synthetic polypeptide
EIQLVQSGAEVKKPGASVKVSCKASGYTFTNYGMYWVKQAPGQGLEYMGWINTETGKPIYADDFKGRFTFTLDTSTSTAYMELRSLRSDDTAVYYCARVDYDGSFWFAYWGQGTLVTVSS

SEQ ID NO: 683 - protein, 120 aa, Artificial Sequence
  Description of Artificial Sequence: Synthetic polypeptide
EIQLVQSGAEVKKPGASVKVSCKASGYTFTNYGMYWVRQAPGQGLEWMGWINTETGKPIYADDFKGRFTFTLDTSTSTAYMELRSLRSDDTAVYYCARVDYDGSFWFAYWGQGTLVTVSS

SEQ ID NO: 684 - protein, 120 aa, Artificial Sequence
  Description of Artificial Sequence: Synthetic polypeptide
QVQLVQSGSELKKPGASVKVSCKASGYTFTNYGMYWVRQAPGQGLEWMGWINTETGKPIYADDFKGRFVFSLDTSVSTAYLQISSLKAEDTAVYYCARVDYDGSFWFAYWGQGTLVTVSS

SEQ ID NO: 685 - protein, 120 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPIYADDFKGRFVFSLDTSVSTAYLQISSLKAEDTAVYYCARVDYDGSFWFAYWGQGTLVTVSS

SEQ ID NO: 686 - protein, 120 aa, Artificial Sequence
  Description of Artificial Sequence: Synthetic polypeptide
EIQLVQSGSELKKPGASVKVSCKASGYTFTNYGMYWVKQAPGQGLEYMGWINTETGKPIYADDFKGRFVFSLDTSVSTAYLQISSLKAEDTAVYYCARVDYDGSFWFAYWGQGTLVTVSS

SEQ ID NO: 687 - protein, 120 aa, Artificial Sequence
  Description of Artificial Sequence: Synthetic polypeptide
EIQLVQSGSELKKPGASVKVSCKASGYTFTNYGMYWVRQAPGQGLEWMGWINTETGKPIYADDFKGRFVFSLDTSVSTAYLQISSLKAEDTAVYYCARVDYDGSFWFAYWGQGTLVTVSS

SEQ ID NO: 688 - protein, 120 aa, Artificial Sequence
  Description of Artificial Sequence: Synthetic polypeptide
EIQLVQSGSELKKPGASVKVSCKASGYTFTNYGMYWVKQAPGQGLEYMGWINTETGKPIYADDFKGRFVFSLDTSVSTAYLQISSLKAEDTAVFFCARVDYDGSFWFAYWGQGTLVTVSS

SEQ ID NO: 689 - protein, 107 aa, Artificial Sequence
  Description of Artificial Sequence: Synthetic polypeptide
EIVLTQSPDFQSVTPKEKVTITCRASESVSTVIHWYQQKPDQSPKLLIKGASNLESGVPSRFSGSGSGTDFTLTINSLEAEDAATYYCQQHWNDPPTFGQGTKLEIK

SEQ ID NO: 690 - protein, 107 aa, Artificial Sequence
  Description of Artificial Sequence: Synthetic polypeptide
ETVLTQSPDFQSVTPKEKVTITCRASESVSTVIHWYQQKPDQQPKLLIHGASNLESGVPSRFSGSGSGTDFTLTINSLEAEDAATYFCQQHWNDPPTFGQGTKLEIK

SEQ ID NO: 691 - protein, 107 aa, Artificial Sequence
  Description of Artificial Sequence: Synthetic polypeptide
ETVLTQSPDFQSVTPKEKVTITCRASESVSTVIHWYQQKPDQSPKLLIHGASNLESGVPSRFSGSGSGTDFTLTINSLEAEDAATYYCQQHWNDPPTFGQGTKLEIK

SEQ ID NO: 692 - protein, 106 aa, Artificial Sequence
  Description of Artificial Sequence: Synthetic polypeptide
ETVLTQSPDQSVTPKEKVTITCRASESVSTVIHWYQQKPDQSPKLLIHGASNLESGVPSRFSGSGSGTDFTLTINSLEAEDAATYYCQQHWNDPPTFGQGTKLEIK

SEQ ID NO: 693 - protein, 107 aa, Artificial Sequence
  Description of Artificial Sequence: Synthetic polypeptide
DIQMTQSPSSLSASVGDRVTITCRASESVSTVIHWYQQKPGKAPKLLIYGASNLESGVPSRFSGSGSGTDFTLTISSLQPEDFATYYCQQHWNDPPTFGQGTKLEIK

SEQ ID NO: 694 - protein, 107 aa, Artificial Sequence; identical to SEQ ID NO: 26
  Description of Artificial Sequence: Synthetic polypeptide

SEQ ID NO: 695 - protein, 107 aa, Artificial Sequence
  Description of Artificial Sequence: Synthetic polypeptide
DTQMTQSPSSLSASVGDRVTITCRASESVSTVIHWYQQKPGKAPKLLIHGASNLESGVPSRFSGSGSGTDFTLTISSLQPEDFATYYCQQHWNDPPTFGQGTKLEIK

SEQ ID NO: 696 - protein, 106 aa, Artificial Sequence
  Description of Artificial Sequence: Synthetic polypeptide
DTQMTQSPSLSASVGDRVTITCRASESVSTVIHWYQQKPGKAPKLLIHGASNLESGVPSRFSGSGSGTDFTLTISSLQPEDFATYYCQQHWNDPPTFGQGTKLEIK

SEQ ID NO: 697 - protein, 107 aa, Artificial Sequence
  Description of Artificial Sequence: Synthetic polypeptide
EIVLTQSPATLSLSPGERATLSCRASESVSTVIHWYQQKPGQAPRLLIYGASNLESGIPARFSGSGSGTDFTLTISSLEPEDFAVYYCQQHWNDPPTFGQGTKLEIK

SEQ ID NO: 698 - protein, 107 aa, Artificial Sequence
  Description of Artificial Sequence: Synthetic polypeptide
ETVLTQSPATLSLSPGERATLSCRASESVSTVIHWYQQKPGQAPRLLIHGASNLESGVPARFSGSGSGTDFTLTISSLEPEDFATYFCQQHWNDPPTFGQGTKLEIK

SEQ ID NO: 699 - protein, 107 aa, Artificial Sequence
  Description of Artificial Sequence: Synthetic polypeptide
ETVLTQSPATLSLSPGERATLSCRASESVSTVIHWYQQKPGQAPRLLIYGASNLESGIPARFSGSGSGTDFTLTISSLEPEDFAVYFCQQHWNDPPTFGQGTKLEIK

SEQ ID NO: 700 - protein, 107 aa, Artificial Sequence
  Description of Artificial Sequence: Synthetic polypeptide
ETVLTQSPATLSLSPGERATLSCRASESVSTVIHWYQQKPGQAPRLLIYGASNLESGIPARFSGSGSGTDFTLTISSLEPEDFAVYYCQQHWNDPPTFGQGTKLEIK

SEQ ID NO: 701 - protein, 107 aa, Artificial Sequence
  Description of Artificial Sequence: Synthetic polypeptide
AIQLTQSPSSLSASVGDRVTITCRASESVSTVIHWYQQKPGKAPKLLIYGASNLESGVPSRFSGSGSGTDFTLTISSLQPEDFATYYCQQHWNDPPTFGQGTKLEIK

SEQ ID NO: 702 - protein, 107 aa, Artificial Sequence
  Description of Artificial Sequence: Synthetic polypeptide
ATQLTQSPSSLSASVGDRVTISCRASESVSTVIHWYQQKPGKAPKLLIHGASNLESGVPSRFSGSGSGTDFTLTISSLQPEDFATYFCQQHWNDPPTFGQGTKLEIK

SEQ ID NO: 703 - protein, 107 aa, Artificial Sequence
  Description of Artificial Sequence: Synthetic polypeptide
ATQLTQSPSSLSASVGDRVTITCRASESVSTVIHWYQQKPGKAPKLLIYGASNLESGVPSRFSGSGSGTDFTLTISSLQPEDFATYFCQQHWNDPPTFGQGTKLEIK

SEQ ID NO: 704 - protein, 107 aa, Artificial Sequence
  Description of Artificial Sequence: Synthetic polypeptide
ATQLTQSPSSLSASVGDRVTITCRASESVSTVIHWYQQKPGKAPKLLIYGASNLESGVPSRFSGSGSGTDFTLTISSLQPEDFATYYCQQHWNDPPTFGQGTKLEIK

SEQ ID NO: 705 - protein, 116 aa, Artificial Sequence
  Description of Artificial Sequence: Synthetic polypeptide
EVQLVESGGGLVQPGGSLRLSCAASGFTFSYYGMHWVRQAPGKGLEWVALIYYDSSKMYYADSVKGRFTISRDNAKNSLYLQMNSLRAEDTAVYYCARGGTAPVYWGQGTMVTVSS

SEQ ID NO: 706 - protein, 116 aa, Artificial Sequence
  Description of Artificial Sequence: Synthetic polypeptide
EVQLVESGGGLVQPGGSLRLSCAASGFTFSYYGMHWIRQAPGKGLEWMALIYYDSSKMYYADSVKGRFTISRDNAKNSLYLQMNSLRAEDTAVYYCAAGGTAPVYWGQGTMVTVSS

SEQ ID NO: 707 - protein, 116 aa, Artificial Sequence
  Description of Artificial Sequence: Synthetic polypeptide
EVQLVESGGGLVQPGGSLRLSCAASGFTFSYYGMHWVRQAPGKGLEWMALIYYDSSKMYYADSVKGRFTISRDNAKNSLYLQMNSLRAEDTAVYYCAAGGTAPVYWGQGTMVTVSS

SEQ ID NO: 708 - protein, 106 aa, Artificial Sequence
  Description of Artificial Sequence: Synthetic polypeptide
EIVLTQSPATLSLSPGERATLSCKGSQNIANYLAWYQQKPGQAPRLLIYNTDSLQTGIPARFSGSGSGTDFTLTISSLEPEDFAVYYCYQSNNGYTFGQGTKLEIK

SEQ ID NO: 709 - protein, 106 aa, Artificial Sequence
  Description of Artificial Sequence: Synthetic polypeptide
EIVLTQSPATLSLSPGERATLSCKGSQNIANYLAWYQQKPGQAPRLLIYNTDSLQTGIPARFSGSGSGTDYTLTISSLEPEDFAVYFCYQSNNGYTFGQGTKLEIK

SEQ ID NO: 710 - protein, 106 aa, Artificial Sequence
  Description of Artificial Sequence: Synthetic polypeptide
DIQMTQSPSSLSASVGDRVTITCKGSQNIANYLAWYQQKPGKAPKLLIYNTDSLQTGVPSRFSGSGSGTDFTLTISSLQPEDFATYYCYQSNNGYTFGQGTKLEIK

SEQ ID NO: 711 - protein, 106 aa, Artificial Sequence
  Description of Artificial Sequence: Synthetic polypeptide
DIQLTQSPSSLSASVGDRVTITCKGSQNIANYLAWYQQKPGKAPKLLIYNTDSLQTGIPSRFSGSGSGTDYTLTISSLQPEDFATYFCYQSNNGYTFGQGTKLEIK

SEQ ID NO: 712 - protein, 121 aa, Artificial Sequence
  Description of Artificial Sequence: Synthetic polypeptide
QVQLVQSGHEVKQPGASVKVSCKASGYTFTNYGMYWVPQAPGQGLEWMGWINTETGKPTYADDFKGRFVFSMDTSASTAYLQISSLKAEDMAMYYCARPSDYYDGFWFAYWGQGTLVTVSS

SEQ ID NO: 713 - protein, 121 aa, Artificial Sequence
  Description of Artificial Sequence: Synthetic polypeptide
EVQLVQSGHEVKQPGASVKVSCKASGYTFTNYGMYWVPQAPGQGLEWMGWINTETGKPTYADDFKGRFVFSMDTSASTAYLQISSLKAEDMAMYYCARPSDYYDGFWFAYWGQGTLVTVSS

SEQ ID NO: 714 - protein, 121 aa, Artificial Sequence
  Description of Artificial Sequence: Synthetic polypeptide
EIQLVQSGHEVKQPGASVKVSCKASGYTFTNYGMYWVKLAPGQGLEYLGWINTETGKPTYADDFKGRFVFSLDTSASTAYLQISSLKAEDMAMYFCARPSDYYDGFWFAYWGQGTLVTVSS

SEQ ID NO: 715 - protein, 121 aa, Artificial Sequence
  Description of Artificial Sequence: Synthetic polypeptide
EVQLVQSGHEVKQPGASVKVSCKASGYTFTNYGMYWVKQAPGQGLEYLGWINTETGKPTYADDFKGRFVFSLDTSASTAYLQISSLKAEDMAMYYCARPSDYYDGFWFAYWGQGTLVTVSS

SEQ ID NO: 716 - protein, 121 aa, Artificial Sequence
  Description of Artificial Sequence: Synthetic polypeptide
EVQLVQSGHEVKQPGASVKVSCKASGYSFTNYGMYWVKQAPGQGLEYLGWINTETGKPTYADDFKGRFVFSLDTSASTAYLQISSLKAEDMAMYYCARPSDYYDGFWFAYWGQGTLVTVSS

SEQ ID NO: 717 - protein, 121 aa, Artificial Sequence
  Description of Artificial Sequence: Synthetic polypeptide
QVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARPSDYYDGFWFAYWGQGTLVTVSS

SEQ ID NO: 718 - protein, 121 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARPSDYYDGFWFAYWGQGTLVTVSS

SEQ ID NO: 719 - protein, 121 aa, Artificial Sequence
  Description of Artificial Sequence: Synthetic polypeptide
EIQLVQSGAEVKKPGASVKVSCKASGYTFTNYGMYWVKLAPGQGLEYLGWINTETGKPTYADDFKGRFTFTLDTSTSTAYLELRSLRSDDTAVYFCARPSDYYDGFWFAYWGQGTLVTVSS

SEQ ID NO: 720 - protein, 121 aa, Artificial Sequence
  Description of Artificial Sequence: Synthetic polypeptide
EVQLVQSGAEVKKPGASVKVSCKASGYTFTNYGMYWVKQAPGQGLEYLGWINTETGKPTYADDFKGRVTMTLDTSTSTAYLELRSLRSDDTAVYYCARPSDYYDGFWFAYWGQGTLVTVSS

SEQ ID NO: 721 - protein, 107 aa, Artificial Sequence
  Description of Artificial Sequence: Synthetic polypeptide
EIVLTQSPATLSLSPGERATLSCRASEWVNSYMHWYQQKPGQAPRLLIYKASNLASGIPARFSGSGSGTDFTLTISSLEPEDFAVYYCQQSWNDPLTFGQGTKLEIK

SEQ ID NO: 722 - protein, 107 aa, Artificial Sequence
  Description of Artificial Sequence: Synthetic polypeptide
ETVLTQSPATLSLSPGERATLSCRASEWVNSYMHWYQQKPGQQPRLLIYKASNLASGVPARFSGSGSGTDFTLTISSLEPEDFAVYFCQQSWNDPLTFGQGTKLEIK

SEQ ID NO: 723 - protein, 107 aa, Artificial Sequence
  Description of Artificial Sequence: Synthetic polypeptide
ETVLTQSPATLSLSPGERATLSCRASEWVNSYMHWYQQKPGQAPRLLIYKASNLASGIPARFSGSGSGTDFTLTISSLEPEDFAVYYCQQSWNDPLTFGQGTKLEIK

SEQ ID NO: 724 - protein, 107 aa, Artificial Sequence
  Description of Artificial Sequence: Synthetic polypeptide
DIQMTQSPSSLSASVGDRVTITCRASEWVNSYMHWYQQKPGKAPKLLIYKASNLASGVPSRFSGSGSGTDFTLTISSLQPEDFATYYCQQSWNDPLTFGQGTKLEIK

SEQ ID NO: 725 - protein, 107 aa, Artificial Sequence
  Description of Artificial Sequence: Synthetic polypeptide
DTQLTQSPSSLSASVGDRVTITCRASEWVNSYMHWYQQKPGKQPKLLIYKASNLASGVPSRFSGSGSGTDFTLTISSLQPEDFATYFCQQSWNDPLTFGQGTKLEIK

SEQ ID NO: 726 - protein, 107 aa, Artificial Sequence
  Description of Artificial Sequence: Synthetic polypeptide
DTQMTQSPSSLSASVGDRVTITCRASEWVNSYMHWYQQKPGKAPKLLIYKASNLASGVPSRFSGSGSGTDFTLTISSLQPEDFATYYCQQSWNDPLTFGQGTKLEIK

SEQ ID NO: 727 - protein, 121 aa, Artificial Sequence
  Description of Artificial Sequence: Synthetic polypeptide
QVQLVQSGHEVKQPGASVKVSCKASGYTFTNYGMYWVPQAPGQGLEWMGWINTETGKPTYADDFKGRFVFSMDTSASTAYLQISSLKAEDMAMYYCARPSDYYDGFWFPYWGQGTLVTVSS

SEQ ID NO: 728 - protein, 121 aa, Artificial Sequence
  Description of Artificial Sequence: Synthetic polypeptide
EVQLVQSGHEVKQPGASVKVSCKASGYTFTNYGMYWVPQAPGQGLEWMGWINTETGKPTYADDFKGRFVFSMDTSASTAYLQISSLKAEDMAMYYCARPSDYYDGFWFPYWGQGTLVTVSS

SEQ ID NO: 729 - protein, 121 aa, Artificial Sequence
  Description of Artificial Sequence: Synthetic polypeptide
EIQLVQSGHEVKQPGASVKVSCKASGYTFTNYGMYWVPQAPGQGLEYMGWINTETGKPTYADDFKGRFVFSLDTSASTAYLQISSLKAEDMAMYFCARPSDYYDGFWFPYWGQGTLVTVSS

SEQ ID NO: 730 - protein, 121 aa, Artificial Sequence
  Description of Artificial Sequence: Synthetic polypeptide
EVQLVQSGHEVKQPGASVKVSCKASGYTFTNYGMYWVPQAPGQGLEYMGWINTETGKPTYADDFKGRFVFSLDTSASTAYLQISSLKAEDMAMYYCARPSDYYDGFWFPYWGQGTLVTVSS

SEQ ID NO: 731 - protein, 121 aa, Artificial Sequence
  Description of Artificial Sequence: Synthetic polypeptide
EVQLVQSGHEVKQPGASVKVSCKASGYSFTNYGMYWVPQAPGQGLEYMGWINTETGKPTYADDFKGRFVFSLDTSASTAYLQISSLKAEDMAMYYCARPSDYYDGFWFPYWGQGTLVTVSS

SEQ ID NO: 732 - protein, 121 aa, Artificial Sequence
  Description of Artificial Sequence: Synthetic polypeptide
QVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARPSDYYDGFWFPYWGQGTLVTVSS

SEQ ID NO: 733 - protein, 121 aa, Artificial Sequence
  Description of Artificial Sequence: Synthetic polypeptide
EVQLVQSGAEVKKPGASVKVSCKASGYTFTNYGMYWVRQAPGQGLEWMGWINTETGKPTYADDFKGRVTMTTDTSTSTAYMELRSLRSDDTAVYYCARPSDYYDGFWFPYWGQGTLVTVSS

SEQ ID NO: 734 - protein, 121 aa, Artificial Sequence
  Description of Artificial Sequence: Synthetic polypeptide
EIQLVQSGAEVKKPGASVKVSCKASGYTFTNYGMYWVRQAPGQGLEYMGWINTETGKPTYADDFKGRFTFTLDTSTSTAYMELRSLRSDDTAVYFCARPSDYYDGFWFPYWGQGTLVTVSS

SEQ ID NO: 735 - protein, 121 aa, Artificial Sequence
  Description of Artificial Sequence: Synthetic polypeptide
EVQLVQSGAEVKKPGASVKVSCKASGYTFTNYGMYWVRQAPGQGLEYMGWINTETGKPTYADDFKGRVTMTLDTSTSTAYMELRSLRSDDTAVYYCARPSDYYDGFWFPYWGQGTLVTVSS

SEQ ID NO: 736 - protein, 107 aa, Artificial Sequence
  Description of Artificial Sequence: Synthetic polypeptide
EIVLTQSPATLSLSPGERATLSCRASEGVNSYMHWYQQKPGQAPRLLIYKASNLASGIPARFSGSGSGTDFTLTISSLEPEDFAVYYCQQSWNDPLTFGQGTKLEIK

SEQ ID NO: 737 - protein, 107 aa, Artificial Sequence
  Description of Artificial Sequence: Synthetic polypeptide
ETVLTQSPATLSLSPGERATLSCRASEGVNSYMHWYQQKPGQQPRLLIYKASNLASGVPARFSGSGSGTDFTLTISSLEPEDFAVYFCQQSWNDPLTFGQGTKLEIK

SEQ ID NO: 738 - protein, 107 aa, Artificial Sequence
  Description of Artificial Sequence: Synthetic polypeptide
ETVLTQSPATLSLSPGERATLSCRASEGVNSYMHWYQQKPGQAPRLLIYKASNLASGIPARFSGSGSGTDFTLTISSLEPEDFAVYYCQQSWNDPLTFGQGTKLEIK

SEQ ID NO: 739 - protein, 107 aa, Artificial Sequence
  Description of Artificial Sequence: Synthetic polypeptide
DIQMTQSPSSLSASVGDRVTITCRASEGVNSYMHWYQQKPGKAPKLLIYKASNLASGVPSRFSGSGSGTDFTLTISSLQPEDFATYYCQQSWNDPLTFGQGTKLEIK

SEQ ID NO: 740 - protein, 107 aa, Artificial Sequence
  Description of Artificial Sequence: Synthetic polypeptide
DTQLTQSPSSLSASVGDRVTITCRASEGVNSYMHWYQQKPGKQPKLLIYKASNLASGVPSRFSGSGSGTDFTLTISSLQPEDFATYFCQQSWNDPLTFGQGTKLEIK

SEQ ID NO: 741 - protein, 107 aa, Artificial Sequence
  Description of Artificial Sequence: Synthetic polypeptide
DTQMTQSPSSLSASVGDRVTITCRASEGVNSYMHWYQQKPGKAPKLLIYKASNLASGVPSRFSGSGSGTDFTLTISSLQPEDFATYYCQQSWNDPLTFGQGTKLEIK

SEQ ID NO: 742 - protein, 118 aa, Artificial Sequence
  Description of Artificial Sequence: Synthetic polypeptide
QVQLVQSGSELKKPGASVKVSCKASGYTFTNYGVYWVRQAPGQGLEWMGWINTETGKPTYADDFKGRFVFSLDTSVSTAYLQISSLKAEDTAVYYCARARQLDWFVYWGQGTLVTVSS

SEQ ID NO: 743 - protein, 118 aa, Artificial Sequence
  Description of Artificial Sequence: Synthetic polypeptide
EVQLVQSGSELKKPGASVKVSCKASGYTFTNYGVYWVRQAPGQGLEWMGWINTETGKPTYADDFKGRFVFSLDTSVSTAYLQISSLKAEDTAVYYCARARQLDWFVYWGQGTLVTVSS

SEQ ID NO: 744 - protein, 118 aa, Artificial Sequence
  Description of Artificial Sequence: Synthetic polypeptide
EIQLVQSGSELKKPGASVKVSCKASGYTFTNYGVYWVKQAPGQGLEYMGWINTETGKPTYADDFKGRFVFSLDTSVSTAYLQISSLKAEDTAVYYCARARQLDWFVYWGQGTLVTVSS

SEQ ID NO: 745 - protein, 118 aa, Artificial Sequence
  Description of Artificial Sequence: Synthetic polypeptide
EIQLVQSGSELKKPGASVKVSCKASGYTFTNYGVYWVKQAPGQGLEYMGWINTETGKPTYADDFKGRFVFSLDTSVSTAYLQISSLKAEDTAVFFCARARQLDWFVYWGQGTLVTVSS

SEQ ID NO: 746 - protein, 118 aa, Artificial Sequence
  Description of Artificial Sequence: Synthetic polypeptide
QVQLVQSGAEVKKPGSSVKVSCKASGYTFTNYGVYWVRQAPGQGLEWMGWINTETGKPTYADDFKGRVTITADKSTSTAYMELSSLRSEDTAVYYCARARQLDWFVYWGQGTLVTVSS

SEQ ID NO: 747 - protein, 118 aa, Artificial Sequence
  Description of Artificial Sequence: Synthetic polypeptide
EVQLVQSGAEVKKPGSSVKVSCKASGYTFTNYGVYWVRQAPGQGLEWMGWINTETGKPTYADDFKGRVTITADKSTSTAYMELSSLRSEDTAVYYCARARQLDWFVYWGQGTLVTVSS

SEQ ID NO: 748 - protein, 118 aa, Artificial Sequence
  Description of Artificial Sequence: Synthetic polypeptide
EIQLVQSGAEVKKPGSSVKVSCKASGYTFTNYGVYWVKQAPGQGLEYMGWINTETGKPTYADDFKGRFTFTLDKSTSTAYMELSSLRSEDTAVYFCARARQLDWFVYWGQGTLVTVSS

SEQ ID NO: 749 - protein, 118 aa, Artificial Sequence
  Description of Artificial Sequence: Synthetic polypeptide
EVQLVQSGAEVKKPGSSVKVSCKASGYTFTNYGVYWVRQAPGQGLEWMGWINTETGKPTYADDFKGRFTFTLDKSTSTAYMELSSLRSEDTAVYYCARARQLDWFVYWGQGTLVTVSS

SEQ ID NO: 750 - protein, 118 aa, Artificial Sequence
  Description of Artificial Sequence: Synthetic polypeptide
EIQLVQSGAEVKKPGSSVKVSCKASGYTFTNYGVYWVKQAPGQGLEYMGWINTETGKPTYADDFKGRFVFTLDKSTSTAYLELSSLRSEDTAVFFCARARQLDWFVYWGQGTLVTVSS

SEQ ID NO: 751 - protein, 107 aa, Artificial Sequence
  Description of Artificial Sequence: Synthetic polypeptide
EIVLTQSPATLSLSPGERATLSCRARESLTTSLCWYQQKPGQAPRLLIYGASKLESGIPARFSGSGSGTDFTLTISSLEPEDFAVYYCQQSWYDPPTFGGGTKVEIK

SEQ ID NO: 752 - protein, 107 aa, Artificial Sequence
  Description of Artificial Sequence: Synthetic polypeptide
DTVLTQSPATLSLSPGERATLSCRARESLTTSLSWFQQKPGQQPRLLIYGASKLESGVPARFSGSGSGTDFTLTISSLEPEDFAVYFCQQSWYDPPTFGGGTKVEIK

SEQ ID NO: 753 - protein, 107 aa, Artificial Sequence
  Description of Artificial Sequence: Synthetic polypeptide
DTVLTQSPATLSLSPGERATLSCRARESLTTSLSWFQQKPGQAPRLLIYGASKLESGIPARFSGSGSGTDFTLTISSLEPEDFAVYFCQQSWYDPPTFGGGTKVEIK

SEQ ID NO: 754 - protein, 107 aa, Artificial Sequence
  Description of Artificial Sequence: Synthetic polypeptide
DTVLTQSPATLSLSPGERATLSCRARESLTTSLSWYQQKPGQAPRLLIYGASKLESGIPARFSGSGSGTDFTLTISSLEPEDFAVYYCQQSWYDPPTFGGGTKVEIK

SEQ ID NO: 755 - protein, 107 aa, Artificial Sequence
  Description of Artificial Sequence: Synthetic polypeptide
AIQLTQSPSSLSASVGDRVTITCRARESLTTSLSWYQQKPGKAPKLLIYGASKLESGVPSRFSGSGSGTDFTLTISSLQPEDFATYYCQQSWYDPPTFGGGTKVEIK

SEQ ID NO: 756 - protein, 107 aa, Artificial Sequence
  Description of Artificial Sequence: Synthetic polypeptide
DTQLTQSPSSLSASVGDRVTISCRARESLTTSLSWFQQKPGKQPKLLIYGASKLESGVPSRFSGSGSGTDFTLTISSLQPEDFATYFCQQSWYDPPTFGGGTKVEIK

SEQ ID NO: 757 - protein, 107 aa, Artificial Sequence
  Description of Artificial Sequence: Synthetic polypeptide
DTQLTQSPSSLSASVGDRVTITCRARESLTTSLSWFQQKPGKAPKLLIYGASKLESGVPSRFSGSGSGTDFTLTISSLQPEDFATYFCQQSWYDPPTFGGGTKVEIK

SEQ ID NO: 758 - protein, 107 aa, Artificial Sequence
  Description of Artificial Sequence: Synthetic polypeptide
DTQLTQSPSSLSASVGDRVTITCRARESLTTSLSWYQQKPGKAPKLLIYGASKLESGVPSRFSGSGSGTDFTLTISSLQPEDFATYYCQQSWYDPPTFGGGTKVEIK

SEQ ID NO: 759 - protein, 124 aa, Artificial Sequence
  Description of Artificial Sequence: Synthetic polypeptide
QVQLVQSGSELKKPGASVKVSCKASGYTFTNYGMYWVRQAPGQGLEWMGWIDTETGRPTYADDFKGRFVFSLDTSVSTAYLQISSLKAEDTAVYYCARWSGDTTGIRGPWFAYWGQGTLVTVSS

SEQ ID NO: 760 - protein, 124 aa, Artificial Sequence
  Description of Artificial Sequence: Synthetic polypeptide
EVQLVQSGSELKKPGASVKVSCKASGYTFTNYGMYWVRQAPGQGLEWMGWIDTETGRPTYADDFKGRFVFSLDTSVSTAYLQISSLKAEDTAVYYCARWSGDTTGIRGPWFAYWGQGTLVTVSS

SEQ ID NO: 761 - protein, 124 aa, Artificial Sequence; identical to SEQ ID NO: 35
  Description of Artificial Sequence: Synthetic polypeptide

SEQ ID NO: 762 - protein, 124 aa, Artificial Sequence
  Description of Artificial Sequence: Synthetic polypeptide
QVQLVQSGAEVKKPGSSVKVSCKASGYTFTNYGMYWVRQAPGQGLEWMGWIDTETGRPTYADDFKGRVTITADKSTSTAYMELSSLRSEDTAVYYCARWSGDTTGIRGPWFAYWGQGTLVTVSS

SEQ ID NO: 763 - protein, 124 aa, Artificial Sequence
  Description of Artificial Sequence: Synthetic polypeptide
EVQLVQSGAEVKKPGSSVKVSCKASGYTFTNYGMYWVRQAPGQGLEWMGWIDTETGRPTYADDFKGRVTITADKSTSTAYMELSSLRSEDTAVYYCARWSGDTTGIRGPWFAYWGQGTLVTVSS

SEQ ID NO: 764 - protein, 124 aa, Artificial Sequence
  Description of Artificial Sequence: Synthetic polypeptide
EIQLVQSGAEVKKPGSSVKVSCKASGYTFTNYGMYWVKQAPGQGLEYMGWIDTETGRPTYADDFKGRFTFTADKSTSTAYMELSSLRSEDTAVYFCARWSGDTTGIRGPWFAYWGQGTLVTVSS

SEQ ID NO: 765 - protein, 124 aa, Artificial Sequence; identical to SEQ ID NO: 37
  Description of Artificial Sequence: Synthetic polypeptide

SEQ ID NO: 766 - protein, 107 aa, Artificial Sequence
  Description of Artificial Sequence: Synthetic polypeptide
DIQMTQSPSSLSASVGDRVTITCLASEDIYSDLAWYQQKPGKVPKLLIYNANGLQNGVPSRFSGSGSGTDFTLTISSLQPEDVATYYCQQYNYFPGTFGQGTKLEIK

SEQ ID NO: 767 - protein, 107 aa, Artificial Sequence; identical to SEQ ID NO: 36
  Description of Artificial Sequence: Synthetic polypeptide

SEQ ID NO: 768 - protein, 107 aa, Artificial Sequence; identical to SEQ ID NO: 38
  Description of Artificial Sequence: Synthetic polypeptide

SEQ ID NO: 769 - protein, 116 aa, Artificial Sequence
  Description of Artificial Sequence: Synthetic polypeptide
EVQLVESGGGLVQPGGSLRLSCAASGFSFSKYDMAWVRQAPGKGLEWVASITTSGVGTYYRDSVKGRFTISRDNAKNSLYLQMNSLRAEDTAVYYCARGYGAMDAWGQGTTVTVSS

SEQ ID NO: 770 - protein, 116 aa, Artificial Sequence; identical to SEQ ID NO: 39
  Description of Artificial Sequence: Synthetic polypeptide

SEQ ID NO: 771 - protein, 116 aa, Artificial Sequence
  Description of Artificial Sequence: Synthetic polypeptide
EVQLVESGGGLVQPGGSLRLSCAASGFSFSKYDMAWFRQAPGKGLEWVASITTSGVGTYYRDSVKGRFTVSRDNAKNSLYLQMNSLRAEDTAVYYCARGYGAMDAWGQGTTVTVSS

SEQ ID NO: 772 - protein, 107 aa, Artificial Sequence
  Description of Artificial Sequence: Synthetic polypeptide
DIQMTQSPSSLSASVGDRVTITCKASQDIDDYLSWYQQKPGKAPKLLIYAATRLADGVPSRFSGSGSGTDFTLTISSLQPEDFATYYCLQSSSTPWTFGGGTKVEIK

SEQ ID NO: 773 - protein, 107 aa, Artificial Sequence; identical to SEQ ID NO: 40
  Description of Artificial Sequence: Synthetic polypeptide

SEQ ID NO: 774 - protein, 107 aa, Artificial Sequence
  Description of Artificial Sequence: Synthetic polypeptide
DIQMTQSPSSLSASVGDRVTITCKASQDIDDYLSWYQQKPGKSPKLLIYAATRLADGVPSRFSGSGSGTDYTLTISSLQPEDFATYYCLQSSSTPWTFGGGTKVEIK

SEQ ID NO: 775 - protein, 123 aa, Artificial Sequence
  Description of Artificial Sequence: Synthetic polypeptide
QVQLVQSGSELKKPGASVKVSCKASGYPFTNSGMYWVRQAPGQGLEWMGWINTEAGKPTYADDFKGRFVFSLDTSVSTAYLQISSLKAEDTAVYYCARWGYISDNSYGWFDYWGQGTLVTVSS

SEQ ID NO: 776 - protein, 123 aa, Artificial Sequence
  Description of Artificial Sequence: Synthetic polypeptide
EVQLVQSGSELKKPGASVKVSCKASGYPFTNSGMYWVRQAPGQGLEWMGWINTEAGKPTYADDFKGRFVFSLDTSVSTAYLQISSLKAEDTAVYYCARWGYISDNSYGWFDYWGQGTLVTVSS

SEQ ID NO: 777 - protein, 123 aa, Artificial Sequence; identical to SEQ ID NO: 41
  Description of Artificial Sequence: Synthetic polypeptide

SEQ ID NO: 778 - protein, 123 aa, Artificial Sequence
  Description of Artificial Sequence: Synthetic polypeptide
QVQLVQSGAEVKKPGASVKVSCKASGYPFTNSGMYWVRQAPGQGLEWMGWINTEAGKPTYADDFKGRVTMTTDTSTSTAYMELRSLRSDDTAVYYCARWGYISDNSYGWFDYWGQGTLVTVSS

SEQ ID NO: 779 - protein, 123 aa, Artificial Sequence
  Description of Artificial Sequence: Synthetic polypeptide
EVQLVQSGAEVKKPGASVKVSCKASGYPFTNSGMYWVRQAPGQGLEWMGWINTEAGKPTYADDFKGRVTMTTDTSTSTAYMELRSLRSDDTAVYYCARWGYISDNSYGWFDYWGQGTLVTVSS

SEQ ID NO: 780 - protein, 123 aa, Artificial Sequence
  Description of Artificial Sequence: Synthetic polypeptide
EIQLVQSGAEVKKPGASVKVSCKASGYPFTNSGMYWVKQAPGQGLEYMGWINTEAGKPTYADDFKGRFTFTLDTSTSTAYLEIRSLRSDDTAVYFCARWGYISDNSYGWFDYWGQGTLVTVSS

SEQ ID NO: 781 - protein, 123 aa, Artificial Sequence
  Description of Artificial Sequence: Synthetic polypeptide
EVQLVQSGAEVKKPGASVKVSCKASGYPFTNSGMYWVRQAPGQGLEWMGWINTEAGKPTYADDFKGRFTFTLDTSTSTAYLEIRSLRSDDTAVYYCARWGYISDNSYGWFDYWGQGTLVTVSS

SEQ ID NO: 782 - protein, 107 aa, Artificial Sequence
  Description of Artificial Sequence: Synthetic polypeptide
EIVLTQSPATLSLSPGERATLSCRASEGVYSYMHWYQQKPGQAPRLLIYKASNLASGIPARFSGSGSGTDFTLTISSLEPEDFAVYYCHQNWNDPLTFGQGTKLEIK

SEQ ID NO: 783 - protein, 107 aa, Artificial Sequence
  Description of Artificial Sequence: Synthetic polypeptide
ETVLTQSPATLSLSPGERATLSCRASEGVYSYMHWYQQKPGQQPRLLIYKASNLASGVPARFSGSGSGTDFTLTISSLEPEDFAVYFCHQNWNDPLTFGQGTKLEIK

SEQ ID NO: 784 - protein, 107 aa, Artificial Sequence
  Description of Artificial Sequence: Synthetic polypeptide
EIVLTQSPATLSLSPGERATLSCRASEGVYSYMHWYQQKPGQAPRLLIYKASNLASGVPARFSGSGSGTDFTLTISSLEPEDFAVYFCHQNWNDPLTFGQGTKLEIK

SEQ ID NO: 785 - protein, 107 aa, Artificial Sequence
  Description of Artificial Sequence: Synthetic polypeptide
AIQLTQSPSSLSASVGDRVTITCRASEGVYSYMHWYQQKPGKAPKLLIYKASNLASGVPSRFSGSGSGTDFTLTISSLQPEDFATYYCHQNWNDPLTFGQGTKLEIK

SEQ ID NO: 786 - protein, 107 aa, Artificial Sequence; identical to SEQ ID NO: 42
  Description of Artificial Sequence: Synthetic polypeptide

SEQ ID NO: 787 - protein, 107 aa, Artificial Sequence
  Description of Artificial Sequence: Synthetic polypeptide
AIQLTQSPSSLSASVGDRVTITCRASEGVYSYMHWYQQKPGKAPKLLIYKASNLASGVPSRFSGSGSGTDFTLTISSLQPEDFATYFCHQNWNDPLTFGQGTKLEIK

SEQ ID NO: 788 - protein, 120 aa, Artificial Sequence
  Description of Artificial Sequence: Synthetic polypeptide
QVQLVQSGSELKKPGASVKVSCKASGYTFTNYGMYWVRQAPGQGLEWMGWINTETGQPTYADDFKGRFVFSLDTSVSTAYLQISSLKAEDTAVYYCARLGNNYGIWFAYWGQGTLVTVSS

SEQ ID NO: 789 - protein, 120 aa, Artificial Sequence
  Description of Artificial Sequence: Synthetic polypeptide
EVQLVQSGSELKKPGASVKVSCKASGYTFTNYGMYWVRQAPGQGLEWMGWINTETGQPTYADDFKGRFVFSLDTSVSTAYLQISSLKAEDTAVYYCARLGNNYGIWFAYWGQGTLVTVSS

SEQ ID NO: 790 - protein, 120 aa, Artificial Sequence
  Description of Artificial Sequence: Synthetic polypeptide
EVQLVQSGSELKKPGASVKVSCKASGYTFTNYGMYWVKQAPGQGLEFMGWINTETGQPTYADDFKGRFVFSLDTSVSTAYLQISSLKAEDTAVYFCARLGNNYGIWFAYWGQGTLVTVSS

SEQ ID NO: 791 - protein, 120 aa, Artificial Sequence
  Description of Artificial Sequence: Synthetic polypeptide
EVQLVQSGSELKKPGASVKVSCKASGYTFTNYGMYWVRQAPGQGLEFMGWINTETGQPTYADDFKGRFVFSLDTSVSTAYLQISSLKAEDTAVYYCARLGNNYGIWFAYWGQGTLVTVSS

SEQ ID NO: 792 - protein, 120 aa, Artificial Sequence
  Description of Artificial Sequence: Synthetic polypeptide
QVQLVQSGAEVKKPGASVKVSCKASGYTFTNYGMYWVRQAPGQGLEWMGWINTETGQPTYADDFKGRVTMTTDTSTSTAYMELRSLRSDDTAVYYCARLGNNYGIWFAYWGQGTLVTVSS

SEQ ID NO: 793 - protein, 120 aa, Artificial Sequence
  Description of Artificial Sequence: Synthetic polypeptide
EVQLVQSGAEVKKPGASVKVSCKASGYTFTNYGMYWVRQAPGQGLEWMGWINTETGQPTYADDFKGRVTMTTDTSTSTAYMELRSLRSDDTAVYYCARLGNNYGIWFAYWGQGTLVTVSS

SEQ ID NO: 794 - protein, 120 aa, Artificial Sequence
  Description of Artificial Sequence: Synthetic polypeptide
EVQLVQSGAEVKKPGASVKVSCKASGYTFTNYGMYWVKQAPGQGLEFMGWINTETGQPTYADDFKGRFTFTLDTSTSTAYMELRSLRSDDTAVYFCARLGNNYGIWFAYWGQGTLVTVSS

SEQ ID NO: 795 - protein, 120 aa, Artificial Sequence
  Description of Artificial Sequence: Synthetic polypeptide
EVQLVQSGAEVKKPGASVKVSCKASGYTFTNYGMYWVRQAPGQGLEFMGWINTETGQPTYADDFKGRFTFTLDTSTSTAYMELRSLRSDDTAVYYCARLGNNYGIWFAYWGQGTLVTVSS

SEQ ID NO: 796 - protein, 107 aa, Artificial Sequence
  Description of Artificial Sequence: Synthetic polypeptide
DIQMTQSPSSLSASVGDRVTITCRASDDLYSTLAWYQQKPGKVPKLLIYDANRLAAGVPSRFSGSGSGTDFTLTISSLQPEDVATYYCQQYNKFPWTFGGGTKVEIK

SEQ ID NO: 797 - protein, 107 aa, Artificial Sequence
  Description of Artificial Sequence: Synthetic polypeptide
DIQMTQSPSSLSASVGDRVTIECRASDDLYSTLAWYQQKPGKSPKLLIFDANRLAAGVPSRFSGSGSGTDYSLTISSLQPEDVATYFCQQYNKFPWTFGGGTKVEIK

SEQ ID NO: 798 - protein, 107 aa, Artificial Sequence
  Description of Artificial Sequence: Synthetic polypeptide
DIQMTQSPSSLSASVGDRVTITCRASDDLYSTLAWYQQKPGKSPKLLIFDANRLAAGVPSRFSGSGSGTDYTLTISSLQPEDVATYFCQQYNKFPWTFGGGTKVEIK

SEQ ID NO: 799 - protein, 119 aa, Artificial Sequence
  Description of Artificial Sequence: Synthetic polypeptide
EVQLVESGGGLVQPGGSLRLSCAASGFTFSNYGMAWVRQAPGKGLEWVASITNSGGNTYYRDSVKGRFTISRDNAKNSLYLQMNSLRAEDTAVYYCARHTPGANYFDYWGQGTMVTVSS

SEQ ID NO: 800 - protein, 119 aa, Artificial Sequence
  Description of Artificial Sequence: Synthetic polypeptide
EVQLVESGGGLVQPGGSLRLSCAASGFTFSNYGMAWVRQAPGKGLEWVASITNSGGNTYYRDSVKGRFTISRDNAKNTQYLQMNSLRAEDTAVYFCARHTPGANYFDYWGQGTMVTVSS

SEQ ID NO: 801 - protein, 106 aa, Artificial Sequence
  Description of Artificial Sequence: Synthetic polypeptide
DIQMTQSPSSLSASVGDRVTITCQASQSIKNYIAWYQQKPGKAPKLLIYYTSTLESGVPSRFSGSGSGTDFTFTISSLQPEDIATYYCVQYANLYTFGGGTKVEIK

SEQ ID NO: 802 - protein, 106 aa, Artificial Sequence
  Description of Artificial Sequence: Synthetic polypeptide
DIQMTQSPSSLSASVGDRVTITCQASQSIKNYIAWYQLKPGKAPRLLMRYTSTLESGTPSRFSGSGSGRDYTFTISSLQPEDIATYYCVQYANLYTFGGGTKVEIK

SEQ ID NO: 803 - protein, 106 aa, Artificial Sequence
  Description of Artificial Sequence: Synthetic polypeptide
DIQMTQSPSSLSASVGDRVTITCQASQSIKNYIAWYQQKPGKAPRLLIRYTSTLESGVPSRFSGSGSGRDYTFTISSLQPEDIATYYCVQYANLYTFGGGTKVEIK

SEQ ID NO: 804 - protein, 123 aa, Artificial Sequence; identical to SEQ ID NO: 17
  Description of Artificial Sequence: Synthetic polypeptide

SEQ ID NO: 805 - protein, 10 aa, Artificial Sequence
  Description of Artificial Sequence: Synthetic peptide
GYTFTNYGMY

SEQ ID NO: 806 - protein, 17 aa, Artificial Sequence
  Description of Artificial Sequence: Synthetic peptide
WINTETGKPTYADDFKG

SEQ ID NO: 807 - protein, 14 aa, Artificial Sequence
  Description of Artificial Sequence: Synthetic peptide
TNYYYRSYIFYFDY

SEQ ID NO: 808 - protein, 107 aa, Artificial Sequence; identical to SEQ ID NO: 30
  Description of Artificial Sequence: Synthetic polypeptide

SEQ ID NO: 809 - protein, 11 aa, Artificial Sequence
  Description of Artificial Sequence: Synthetic peptide
RASESVSTHMH

SEQ ID NO: 810 - protein, 7 aa, Artificial Sequence
  Description of Artificial Sequence: Synthetic peptide
GASNLES

SEQ ID NO: 811 - protein, 9 aa, Artificial Sequence
  Description of Artificial Sequence: Synthetic peptide
QQSWNDPFT

SEQ ID NO: 812 - protein, 123 aa, Artificial Sequence; identical to SEQ ID NO: 33
  Description of Artificial Sequence: Synthetic polypeptide

SEQ ID NO: 813 - protein, 10 aa, Artificial Sequence
  Description of Artificial Sequence: Synthetic peptide
GYTFTNYGMY

SEQ ID NO: 814 - protein, 17 aa, Artificial Sequence
  Description of Artificial Sequence: Synthetic peptide
WINTETGKPTYADDFKG

SEQ ID NO: 815 - protein, 14 aa, Artificial Sequence
  Description of Artificial Sequence: Synthetic peptide
TNYYYRSYIFYFDY

SEQ ID NO: 816 - protein, 107 aa, Artificial Sequence; identical to SEQ ID NO: 30
  Description of Artificial Sequence: Synthetic polypeptide

SEQ ID NO: 817 - protein, 11 aa, Artificial Sequence
  Description of Artificial Sequence: Synthetic peptide
RASESVSTHMH

SEQ ID NO: 818 - protein, 7 aa, Artificial Sequence
  Description of Artificial Sequence: Synthetic peptide
GASNLES

SEQ ID NO: 819 - protein, 9 aa, Artificial Sequence
  Description of Artificial Sequence: Synthetic peptide
QQSWNDPFT

SEQ ID NO: 820 - protein, 123 aa, Artificial Sequence; identical to SEQ ID NO: 33
  Description of Artificial Sequence: Synthetic polypeptide

SEQ ID NO: 821 - protein, 10 aa, Artificial Sequence
  Description of Artificial Sequence: Synthetic peptide
GYTFTNYGMY

SEQ ID NO: 822 - protein, 17 aa, Artificial Sequence
  Description of Artificial Sequence: Synthetic peptide
WINTETGKPTYADDFKG

SEQ ID NO: 823 - protein, 14 aa, Artificial Sequence
  Description of Artificial Sequence: Synthetic peptide
TNYYYRSYIFYFDY

SEQ ID NO: 824 - protein, 106 aa, Artificial Sequence; identical to SEQ ID NO: 28
  Description of Artificial Sequence: Synthetic polypeptide

SEQ ID NO: 825 - protein, 11 aa, Artificial Sequence
  Description of Artificial Sequence: Synthetic peptide
RASESVSTHMH

SEQ ID NO: 826 - protein, 7 aa, Artificial Sequence
  Description of Artificial Sequence: Synthetic peptide
GASNLES

SEQ ID NO: 827 - protein, 9 aa, Artificial Sequence
  Description of Artificial Sequence: Synthetic peptide
QQSWNDPFT

SEQ ID NO: 828 - protein, 123 aa, Artificial Sequence; identical to SEQ ID NO: 33
  Description of Artificial Sequence: Synthetic polypeptide

SEQ ID NO: 829 - protein, 10 aa, Artificial Sequence
  Description of Artificial Sequence: Synthetic peptide
GYTFTNYGMY

SEQ ID NO: 830 - protein, 17 aa, Artificial Sequence
  Description of Artificial Sequence: Synthetic peptide
WINTETGKPTYADDFKG

SEQ ID NO: 831 - protein, 14 aa, Artificial Sequence
  Description of Artificial Sequence: Synthetic peptide
TNYYYRSYIFYFDY

SEQ ID NO: 832 - protein, 107 aa, Artificial Sequence; identical to SEQ ID NO: 18
  Description of Artificial Sequence: Synthetic polypeptide

SEQ ID NO: 833 - protein, 11 aa, Artificial Sequence
  Description of Artificial Sequence: Synthetic peptide
RASESVSTHMH

SEQ ID NO: 834 - protein, 7 aa, Artificial Sequence
  Description of Artificial Sequence: Synthetic peptide
GASNLES

SEQ ID NO: 835 - protein, 9 aa, Artificial Sequence
  Description of Artificial Sequence: Synthetic peptide
QQSWNDPFT

SEQ ID NO: 836 - protein, 123 aa, Artificial Sequence; identical to SEQ ID NO: 19
  Description of Artificial Sequence: Synthetic polypeptide

SEQ ID NO: 837 - protein, 10 aa, Artificial Sequence
  Description of Artificial Sequence: Synthetic peptide
GYTFTNYGMY

SEQ ID NO: 838 - protein, 17 aa, Artificial Sequence
  Description of Artificial Sequence: Synthetic peptide
WINTETGKPTYADDFKG

SEQ ID NO: 839 - protein, 14 aa, Artificial Sequence
  Description of Artificial Sequence: Synthetic peptide
TNYYYRSYIFYFDY

SEQ ID NO: 840 - protein, 107 aa, Artificial Sequence; identical to SEQ ID NO: 20
  Description of Artificial Sequence: Synthetic polypeptide

SEQ ID NO: 841 - protein, 11 aa, Artificial Sequence
  Description of Artificial Sequence: Synthetic peptide
RASESVSTHMH

SEQ ID NO: 842 - protein, 7 aa, Artificial Sequence
  Description of Artificial Sequence: Synthetic peptide
GASNLES

SEQ ID NO: 843 - protein, 9 aa, Artificial Sequence
  Description of Artificial Sequence: Synthetic peptide
QQSWNDPFT

SEQ ID NO: 844 - protein, 123 aa, Artificial Sequence; identical to SEQ ID NO: 21
  Description of Artificial Sequence: Synthetic polypeptide

SEQ ID NO: 845 - protein, 10 aa, Artificial Sequence
  Description of Artificial Sequence: Synthetic peptide
GYTFTNYGMY

SEQ ID NO: 846 - protein, 17 aa, Artificial Sequence
  Description of Artificial Sequence: Synthetic peptide
WINTETGKPTYADDFKG

SEQ ID NO: 847 - protein, 14 aa, Artificial Sequence
  Description of Artificial Sequence: Synthetic peptide
TNYYYRSYIFYFDY

SEQ ID NO: 848 - protein, 107 aa, Artificial Sequence; identical to SEQ ID NO: 22
  Description of Artificial Sequence: Synthetic polypeptide

SEQ ID NO: 849 - protein, 11 aa, Artificial Sequence
  Description of Artificial Sequence: Synthetic peptide
RASESVSTHMH

SEQ ID NO: 850 - protein, 7 aa, Artificial Sequence
  Description of Artificial Sequence: Synthetic peptide
GASNLES

SEQ ID NO: 851 - protein, 9 aa, Artificial Sequence
  Description of Artificial Sequence: Synthetic peptide
QQSWNDPFT

SEQ ID NO: 852 - protein, 123 aa, Artificial Sequence; identical to SEQ ID NO: 23
  Description of Artificial Sequence: Synthetic polypeptide

SEQ ID NO: 853 - protein, 10 aa, Artificial Sequence
  Description of Artificial Sequence: Synthetic peptide
GYTFTNYGMY

SEQ ID NO: 854 - protein, 17 aa, Artificial Sequence
  Description of Artificial Sequence: Synthetic peptide
WINTETGKPTYADDFKG

SEQ ID NO: 855 - protein, 14 aa, Artificial Sequence
  Description of Artificial Sequence: Synthetic peptide
TNYYYRSYIFYFDY

SEQ ID NO: 856 - protein, 107 aa, Artificial Sequence; identical to SEQ ID NO: 24
  Description of Artificial Sequence: Synthetic polypeptide

SEQ ID NO: 857 - protein, 11 aa, Artificial Sequence
  Description of Artificial Sequence: Synthetic peptide
RASESVSTHMH

SEQ ID NO: 858 - protein, 7 aa, Artificial Sequence
  Description of Artificial Sequence: Synthetic peptide
GASNLES

SEQ ID NO: 859 - protein, 9 aa, Artificial Sequence
  Description of Artificial Sequence: Synthetic peptide
QQSWNDPFT

SEQ ID NO: 860 - protein, 123 aa, Artificial Sequence; identical to SEQ ID NO: 17
  Description of Artificial Sequence: Synthetic polypeptide

SEQ ID NO: 861 - protein, 10 aa, Artificial Sequence
  Description of Artificial Sequence: Synthetic peptide
GYTFTNYGMY

SEQ ID NO: 862 - protein, 17 aa, Artificial Sequence
  Description of Artificial Sequence: Synthetic peptide
WINTETGKPTYADDFKG

SEQ ID NO: 863 - protein, 14 aa, Artificial Sequence
  Description of Artificial Sequence: Synthetic peptide
TNYYYRSYIFYFDY

SEQ ID NO: 864 - protein, 106 aa, Artificial Sequence; identical to SEQ ID NO: 28
  Description of Artificial Sequence: Synthetic polypeptide

SEQ ID NO: 865 - protein, 11 aa, Artificial Sequence
  Description of Artificial Sequence: Synthetic peptide
RASESVSTHMH

SEQ ID NO: 866 - protein, 7 aa, Artificial Sequence
  Description of Artificial Sequence: Synthetic peptide
GASNLES

SEQ ID NO: 867 - protein, 9 aa, Artificial Sequence
  Description of Artificial Sequence: Synthetic peptide
QQSWNDPFT

SEQ ID NO: 868 - protein, 123 aa, Artificial Sequence; identical to SEQ ID NO: 17
  Description of Artificial Sequence: Synthetic polypeptide

SEQ ID NO: 869 - protein, 10 aa, Artificial Sequence
  Description of Artificial Sequence: Synthetic peptide
GYTFTNYGMY

SEQ ID NO: 870 - protein, 17 aa, Artificial Sequence
  Description of Artificial Sequence: Synthetic peptide
WINTETGKPTYADDFKG

SEQ ID NO: 871 - protein, 14 aa, Artificial Sequence
  Description of Artificial Sequence: Synthetic peptide
TNYYYRSYIFYFDY

SEQ ID NO: 872 - protein, 107 aa, Artificial Sequence; identical to SEQ ID NO: 18
  Description of Artificial Sequence: Synthetic polypeptide

SEQ ID NO: 873 - protein, 11 aa, Artificial Sequence
  Description of Artificial Sequence: Synthetic peptide
RASESVSTHMH

SEQ ID NO: 874 - protein, 7 aa, Artificial Sequence
  Description of Artificial Sequence: Synthetic peptide
GASNLES

SEQ ID NO: 875 - protein, 9 aa, Artificial Sequence
  Description of Artificial Sequence: Synthetic peptide
QQSWNDPFT

SEQ ID NO: 876 - protein, 123 aa, Artificial Sequence; identical to SEQ ID NO: 29
  Description of Artificial Sequence: Synthetic polypeptide

SEQ ID NO: 877 - protein, 10 aa, Artificial Sequence
  Description of Artificial Sequence: Synthetic peptide
GYTFTNYGMY

SEQ ID NO: 878 - protein, 17 aa, Artificial Sequence
  Description of Artificial Sequence: Synthetic peptide
WINTETGKPTYADDFKG

SEQ ID NO: 879 - protein, 14 aa, Artificial Sequence
  Description of Artificial Sequence: Synthetic peptide
TNYYYRSYIFYFDY

SEQ ID NO: 880 - protein, 107 aa, Artificial Sequence; identical to SEQ ID NO: 30
  Description of Artificial Sequence: Synthetic polypeptide

SEQ ID NO: 881 - protein, 11 aa, Artificial Sequence
  Description of Artificial Sequence: Synthetic peptide
RASESVSTHMH

SEQ ID NO: 882 - protein, 7 aa, Artificial Sequence
  Description of Artificial Sequence: Synthetic peptide
GASNLES

SEQ ID NO: 883 - protein, 9 aa, Artificial Sequence
  Description of Artificial Sequence: Synthetic peptide
QQSWNDPFT

SEQ ID NO: 884 - protein, 123 aa, Artificial Sequence; identical to SEQ ID NO: 29
  Description of Artificial Sequence: Synthetic polypeptide

SEQ ID NO: 885 - protein, 10 aa, Artificial Sequence
  Description of Artificial Sequence: Synthetic peptide
GYTFTNYGMY

SEQ ID NO: 886 - protein, 17 aa, Artificial Sequence
  Description of Artificial Sequence: Synthetic peptide
WINTETGKPTYADDFKG

SEQ ID NO: 887 - protein, 14 aa, Artificial Sequence
  Description of Artificial Sequence: Synthetic peptide
TNYYYRSYIFYFDY

SEQ ID NO: 888 - protein, 106 aa, Artificial Sequence; identical to SEQ ID NO: 28
  Description of Artificial Sequence: Synthetic polypeptide

SEQ ID NO: 889 - protein, 11 aa, Artificial Sequence
  Description of Artificial Sequence: Synthetic peptide
RASESVSTHMH

SEQ ID NO: 890 - protein, 7 aa, Artificial Sequence
  Description of Artificial Sequence: Synthetic peptide
GASNLES

SEQ ID NO: 891 - protein, 9 aa, Artificial Sequence
  Description of Artificial Sequence: Synthetic peptide
QQSWNDPFT

SEQ ID NO: 892 - protein, 123 aa, Artificial Sequence; identical to SEQ ID NO: 29
  Description of Artificial Sequence: Synthetic polypeptide

SEQ ID NO: 893 - protein, 10 aa, Artificial Sequence
  Description of Artificial Sequence: Synthetic peptide
GYTFTNYGMY

SEQ ID NO: 894 - protein, 17 aa, Artificial Sequence
  Description of Artificial Sequence: Synthetic peptide
WINTETGKPTYADDFKG

SEQ ID NO: 895 - protein, 14 aa, Artificial Sequence
  Description of Artificial Sequence: Synthetic peptide
TNYYYRSYIFYFDY

SEQ ID NO: 896 - protein, 107 aa, Artificial Sequence; identical to SEQ ID NO: 18
  Description of Artificial Sequence: Synthetic polypeptide

SEQ ID NO: 897 - protein, 11 aa, Artificial Sequence
  Description of Artificial Sequence: Synthetic peptide
RASESVSTHMH

SEQ ID NO: 898 - protein, 7 aa, Artificial Sequence
  Description of Artificial Sequence: Synthetic peptide
GASNLES

SEQ ID NO: 899 - protein, 9 aa, Artificial Sequence
  Description of Artificial Sequence: Synthetic peptide
QQSWNDPFT

SEQ ID NO: 900 - protein, 123 aa, Artificial Sequence; identical to SEQ ID NO: 659
  Description of Artificial Sequence: Synthetic polypeptide

SEQ ID NO: 901 - protein, 10 aa, Artificial Sequence
  Description of Artificial Sequence: Synthetic peptide
GYTFTNYGMY

SEQ ID NO: 902 - protein, 17 aa, Artificial Sequence
  Description of Artificial Sequence: Synthetic peptide
WINTETGKPTYADDFKG

SEQ ID NO: 903 - protein, 14 aa, Artificial Sequence
  Description of Artificial Sequence: Synthetic peptide
TNYYYRSYIFYFDY

SEQ ID NO: 904 - protein, 107 aa, Artificial Sequence; identical to SEQ ID NO: 30
  Description of Artificial Sequence: Synthetic polypeptide

SEQ ID NO: 905 - protein, 11 aa, Artificial Sequence
  Description of Artificial Sequence: Synthetic peptide
RASESVSTHMH

SEQ ID NO: 906 - protein, 7 aa, Artificial Sequence
  Description of Artificial Sequence: Synthetic peptide
GASNLES

SEQ ID NO: 907 - protein, 9 aa, Artificial Sequence
  Description of Artificial Sequence: Synthetic peptide
QQSWNDPFT

SEQ ID NO: 908 - protein, 123 aa, Artificial Sequence; identical to SEQ ID NO: 659
  Description of Artificial Sequence: Synthetic polypeptide

SEQ ID NO: 909 - protein, 10 aa, Artificial Sequence
  Description of Artificial Sequence: Synthetic peptide
GYTFTNYGMY

SEQ ID NO: 910 - protein, 17 aa, Artificial Sequence
  Description of Artificial Sequence: Synthetic peptide
WINTETGKPTYADDFKG

SEQ ID NO: 911 - protein, 14 aa, Artificial Sequence
  Description of Artificial Sequence: Synthetic peptide
TNYYYRSYIFYFDY

SEQ ID NO: 912 - protein, 106 aa, Artificial Sequence; identical to SEQ ID NO: 28
  Description of Artificial Sequence: Synthetic polypeptide

SEQ ID NO: 913 - protein, 11 aa, Artificial Sequence
  Description of Artificial Sequence: Synthetic peptide
RASESVSTHMH

SEQ ID NO: 914 - protein, 7 aa, Artificial Sequence
  Description of Artificial Sequence: Synthetic peptide
GASNLES

SEQ ID NO: 915 - protein, 9 aa, Artificial Sequence
  Description of Artificial Sequence: Synthetic peptide
QQSWNDPFT

SEQ ID NO: 916 - protein, 123 aa, Artificial Sequence; identical to SEQ ID NO: 659
  Description of Artificial Sequence: Synthetic polypeptide

SEQ ID NO: 917 - protein, 10 aa, Artificial Sequence
  Description of Artificial Sequence: Synthetic peptide
GYTFTNYGMY

SEQ ID NO: 918 - protein, 17 aa, Artificial Sequence
  Description of Artificial Sequence: Synthetic peptide
WINTETGKPTYADDFKG

SEQ ID NO: 919 - protein, 14 aa, Artificial Sequence
  Description of Artificial Sequence: Synthetic peptide
TNYYYRSYIFYFDY

SEQ ID NO: 920 - protein, 107 aa, Artificial Sequence; identical to SEQ ID NO: 18
  Description of Artificial Sequence: Synthetic polypeptide

SEQ ID NO: 921 - protein, 11 aa, Artificial Sequence
  Description of Artificial Sequence: Synthetic peptide
RASESVSTHMH

SEQ ID NO: 922 - protein, 7 aa, Artificial Sequence
  Description of Artificial Sequence: Synthetic peptide
GASNLES

SEQ ID NO: 923 - protein, 9 aa, Artificial Sequence
  Description of Artificial Sequence: Synthetic peptide
QQSWNDPFT

SEQ ID NO: 924 - protein, 116 aa, Artificial Sequence; identical to SEQ ID NO: 39
  Description of Artificial Sequence: Synthetic polypeptide

SEQ ID NO: 925 - protein, 10 aa, Artificial Sequence
  Description of Artificial Sequence: Synthetic peptide
GFSFSKYDMA

SEQ ID NO: 926 - protein, 17 aa, Artificial Sequence
  Description of Artificial Sequence: Synthetic peptide
SITTSGVGTYYRDSVKG

SEQ ID NO: 927 - protein, 7 aa, Artificial Sequence
  Description of Artificial Sequence: Synthetic peptide
GYGAMDA

SEQ ID NO: 928 - protein, 107 aa, Artificial Sequence; identical to SEQ ID NO: 40
  Description of Artificial Sequence: Synthetic polypeptide

SEQ ID NO: 929 - protein, 11 aa, Artificial Sequence
  Description of Artificial Sequence: Synthetic peptide
KASQDIDDYLS

SEQ ID NO: 930 - protein, 7 aa, Artificial Sequence
  Description of Artificial Sequence: Synthetic peptide
AATRLAD

SEQ ID NO: 931 - protein, 9 aa, Artificial Sequence
  Description of Artificial Sequence: Synthetic peptide
LQSSSTPWT

SEQ ID NO: 932 - protein, 116 aa, Artificial Sequence; identical to SEQ ID NO: 771
  Description of Artificial Sequence: Synthetic polypeptide

SEQ ID NO: 933 - protein, 10 aa, Artificial Sequence
  Description of Artificial Sequence: Synthetic peptide
GFSFSKYDMA

SEQ ID NO: 934 - protein, 17 aa, Artificial Sequence
  Description of Artificial Sequence: Synthetic peptide
SITTSGVGTYYRDSVKG

SEQ ID NO: 935 - protein, 7 aa, Artificial Sequence
  Description of Artificial Sequence: Synthetic peptide
GYGAMDA

SEQ ID NO: 936 - protein, 107 aa, Artificial Sequence; identical to SEQ ID NO: 40
  Description of Artificial Sequence: Synthetic polypeptide

SEQ ID NO: 937 - protein, 11 aa, Artificial Sequence
  Description of Artificial Sequence: Synthetic peptide
KASQDIDDYLS

SEQ ID NO: 938 - protein, 7 aa, Artificial Sequence
  Description of Artificial Sequence: Synthetic peptide
AATRLAD

SEQ ID NO: 939 - protein, 9 aa, Artificial Sequence
  Description of Artificial Sequence: Synthetic peptide
LQSSSTPWT

SEQ ID NO: 940 - protein, 123 aa, Artificial Sequence; identical to SEQ ID NO: 41
  Description of Artificial Sequence: Synthetic polypeptide

SEQ ID NO: 941 - protein, 10 aa, Artificial Sequence
  Description of Artificial Sequence: Synthetic peptide
GYPFTNSGMY

SEQ ID NO: 942 - protein, 17 aa, Artificial Sequence
  Description of Artificial Sequence: Synthetic peptide
WINTEAGKPTYADDFKG

SEQ ID NO: 943 - protein, 14 aa, Artificial Sequence
  Description of Artificial Sequence: Synthetic peptide
WGYISDNSYGWFDY

SEQ ID NO: 944 - protein, 107 aa, Artificial Sequence; identical to SEQ ID NO: 783
  Description of Artificial Sequence: Synthetic polypeptide

SEQ ID NO: 945 - protein, 11 aa, Artificial Sequence
  Description of Artificial Sequence: Synthetic peptide
RASEGVYSYMH

SEQ ID NO: 946 - protein, 7 aa, Artificial Sequence
  Description of Artificial Sequence: Synthetic peptide
KASNLAS

SEQ ID NO: 947 - protein, 9 aa, Artificial Sequence
  Description of Artificial Sequence: Synthetic peptide
HQNWNDPLT

SEQ ID NO: 948 - protein, 123 aa, Artificial Sequence; identical to SEQ ID NO: 780
  Description of Artificial Sequence: Synthetic polypeptide

SEQ ID NO: 949 - protein, 10 aa, Artificial Sequence
  Description of Artificial Sequence: Synthetic peptide
GYPFTNSGMY

SEQ ID NO: 950 - protein, 17 aa, Artificial Sequence
  Description of Artificial Sequence: Synthetic peptide
WINTEAGKPTYADDFKG

SEQ ID NO: 951 - protein, 14 aa, Artificial Sequence
  Description of Artificial Sequence: Synthetic peptide
WGYISDNSYGWFDY

SEQ ID NO: 952 - protein, 107 aa, Artificial Sequence; identical to SEQ ID NO: 783
  Description of Artificial Sequence: Synthetic polypeptide

SEQ ID NO: 953 - protein, 11 aa, Artificial Sequence
  Description of Artificial Sequence: Synthetic peptide
RASEGVYSYMH

SEQ ID NO: 954 - protein, 7 aa, Artificial Sequence
  Description of Artificial Sequence: Synthetic peptide
KASNLAS

SEQ ID NO: 955 - protein, 9 aa, Artificial Sequence
  Description of Artificial Sequence: Synthetic peptide
HQNWNDPLT

SEQ ID NO: 956 - protein, 123 aa, Artificial Sequence; identical to SEQ ID NO: 781
  Description of Artificial Sequence: Synthetic polypeptide

SEQ ID NO: 957 - protein, 10 aa, Artificial Sequence
  Description of Artificial Sequence: Synthetic peptide
GYPFTNSGMY

SEQ ID NO: 958 - protein, 17 aa, Artificial Sequence
  Description of Artificial Sequence: Synthetic peptide
WINTEAGKPTYADDFKG

SEQ ID NO: 959 - protein, 14 aa, Artificial Sequence
  Description of Artificial Sequence: Synthetic peptide
WGYISDNSYGWFDY

SEQ ID NO: 960 - protein, 107 aa, Artificial Sequence; identical to SEQ ID NO: 783
  Description of Artificial Sequence: Synthetic polypeptide

SEQ ID NO: 961 - protein, 11 aa, Artificial Sequence
  Description of Artificial Sequence: Synthetic peptide
RASEGVYSYMH

SEQ ID NO: 962 - protein, 7 aa, Artificial Sequence
  Description of Artificial Sequence: Synthetic peptide
KASNLAS

SEQ ID NO: 963 - protein, 9 aa, Artificial Sequence
  Description of Artificial Sequence: Synthetic peptide
HQNWNDPLT

SEQ ID NO: 964 - protein, 123 aa, Artificial Sequence; identical to SEQ ID NO: 41
  Description of Artificial Sequence: Synthetic polypeptide

SEQ ID NO: 965 - protein, 10 aa, Artificial Sequence
  Description of Artificial Sequence: Synthetic peptide
GYPFTNSGMY

SEQ ID NO: 966 - protein, 17 aa, Artificial Sequence
  Description of Artificial Sequence: Synthetic peptide
WINTEAGKPTYADDFKG

SEQ ID NO: 967 - protein, 14 aa, Artificial Sequence
  Description of Artificial Sequence: Synthetic peptide
WGYISDNSYGWFDY

SEQ ID NO: 968 - protein, 107 aa, Artificial Sequence; identical to SEQ ID NO: 42
  Description of Artificial Sequence: Synthetic polypeptide

SEQ ID NO: 969 - protein, 11 aa, Artificial Sequence
  Description of Artificial Sequence: Synthetic peptide
RASEGVYSYMH

SEQ ID NO: 970 - protein, 7 aa, Artificial Sequence
  Description of Artificial Sequence: Synthetic peptide
KASNLAS

SEQ ID NO: 971 - protein, 9 aa, Artificial Sequence
  Description of Artificial Sequence: Synthetic peptide
HQNWNDPLT

SEQ ID NO: 972 - protein, 123 aa, Artificial Sequence; identical to SEQ ID NO: 780
  Description of Artificial Sequence: Synthetic polypeptide

SEQ ID NO: 973 - protein, 10 aa, Artificial Sequence
  Description of Artificial Sequence: Synthetic peptide
GYPFTNSGMY

SEQ ID NO: 974 - protein, 17 aa, Artificial Sequence
  Description of Artificial Sequence: Synthetic peptide
WINTEAGKPTYADDFKG

SEQ ID NO: 975 - protein, 14 aa, Artificial Sequence
  Description of Artificial Sequence: Synthetic peptide
WGYISDNSYGWFDY

SEQ ID NO: 976 - protein, 107 aa, Artificial Sequence; identical to SEQ ID NO: 42
  Description of Artificial Sequence: Synthetic polypeptide

SEQ ID NO: 977 - protein, 11 aa, Artificial Sequence
  Description of Artificial Sequence: Synthetic peptide
RASEGVYSYMH

SEQ ID NO: 978 - protein, 7 aa, Artificial Sequence
  Description of Artificial Sequence: Synthetic peptide
KASNLAS

SEQ ID NO: 979 - protein, 9 aa, Artificial Sequence
  Description of Artificial Sequence: Synthetic peptide
HQNWNDPLT

SEQ ID NO: 980 - protein, 118 aa, Artificial Sequence; identical to SEQ ID NO: 744
  Description of Artificial Sequence: Synthetic polypeptide

SEQ ID NO: 981 - protein, 10 aa, Artificial Sequence
  Description of Artificial Sequence: Synthetic peptide
GYTFTNYGVY

SEQ ID NO: 982 - protein, 17 aa, Artificial Sequence
  Description of Artificial Sequence: Synthetic peptide
WINTETGKPTYADDFKG

SEQ ID NO: 983 - protein, 9 aa, Artificial Sequence
  Description of Artificial Sequence: Synthetic peptide
ARQLDWFVY

SEQ ID NO: 984 - protein, 107 aa, Artificial Sequence; identical to SEQ ID NO: 752
  Description of Artificial Sequence: Synthetic polypeptide

SEQ ID NO: 985 - protein, 11 aa, Artificial Sequence
  Description of Artificial Sequence: Synthetic peptide
RARESLTTSLS

SEQ ID NO: 986 - protein, 7 aa, Artificial Sequence
  Description of Artificial Sequence: Synthetic peptide
GASKLES

SEQ ID NO: 987 - protein, 9 aa, Artificial Sequence
  Description of Artificial Sequence: Synthetic peptide
QQSWYDPPT

SEQ ID NO: 988 - protein, 118 aa, Artificial Sequence; identical to SEQ ID NO: 748
  Description of Artificial Sequence: Synthetic polypeptide

SEQ ID NO: 989 - protein, 10 aa, Artificial Sequence
  Description of Artificial Sequence: Synthetic peptide
GYTFTNYGVY

SEQ ID NO: 990 - protein, 17 aa, Artificial Sequence
  Description of Artificial Sequence: Synthetic peptide
WINTETGKPTYADDFKG

SEQ ID NO: 991 - protein, 9 aa, Artificial Sequence
  Description of Artificial Sequence: Synthetic peptide
ARQLDWFVY

SEQ ID NO: 992 - protein, 107 aa, Artificial Sequence; identical to SEQ ID NO: 752
  Description of Artificial Sequence: Synthetic polypeptide

SEQ ID NO: 993 - protein, 11 aa, Artificial Sequence
  Description of Artificial Sequence: Synthetic peptide
RARESLTTSLS

SEQ ID NO: 994 - protein, 7 aa, Artificial Sequence
  Description of Artificial Sequence: Synthetic peptide
GASKLES

SEQ ID NO: 995 - protein, 9 aa, Artificial Sequence
  Description of Artificial Sequence: Synthetic peptide
QQSWYDPPT

SEQ ID NO: 996 - protein, 118 aa, Artificial Sequence; identical to SEQ ID NO: 749
  Description of Artificial Sequence: Synthetic polypeptide

SEQ ID NO: 997 - protein, 10 aa, Artificial Sequence
  Description of Artificial Sequence: Synthetic peptide
GYTFTNYGVY

SEQ ID NO: 998 - protein, 17 aa, Artificial Sequence
  Description of Artificial Sequence: Synthetic peptide
WINTETGKPTYADDFKG

SEQ ID NO: 999 - protein, 9 aa, Artificial Sequence
  Description of Artificial Sequence: Synthetic peptide
ARQLDWFVY

SEQ ID NO: 1000 - protein, 107 aa, Artificial Sequence; identical to SEQ ID NO: 752
  Description of Artificial Sequence: Synthetic polypeptide

SEQ ID NO: 1001 - protein, 11 aa, Artificial Sequence
  Description of Artificial Sequence: Synthetic peptide
RARESLTTSLS

SEQ ID NO: 1002 - protein, 7 aa, Artificial Sequence
  Description of Artificial Sequence: Synthetic peptide
GASKLES

SEQ ID NO: 1003 - protein, 9 aa, Artificial Sequence
  Description of Artificial Sequence: Synthetic peptide
QQSWYDPPT

SEQ ID NO: 1004 - protein, 118 aa, Artificial Sequence; identical to SEQ ID NO: 744
  Description of Artificial Sequence: Synthetic polypeptide

SEQ ID NO: 1005 - protein, 10 aa, Artificial Sequence
  Description of Artificial Sequence: Synthetic peptide
GYTFTNYGVY

SEQ ID NO: 1006 - protein, 17 aa, Artificial Sequence
  Description of Artificial Sequence: Synthetic peptide
WINTETGKPTYADDFKG

SEQ ID NO: 1007 - protein, 9 aa, Artificial Sequence
  Description of Artificial Sequence: Synthetic peptide
ARQLDWFVY

SEQ ID NO: 1008 - protein, 107 aa, Artificial Sequence; identical to SEQ ID NO: 756
  Description of Artificial Sequence: Synthetic polypeptide

SEQ ID NO: 1009 - protein, 11 aa, Artificial Sequence
  Description of Artificial Sequence: Synthetic peptide
RARESLTTSLS

SEQ ID NO: 1010 - protein, 7 aa, Artificial Sequence
  Description of Artificial Sequence: Synthetic peptide
GASKLES

SEQ ID NO: 1011 - protein, 9 aa, Artificial Sequence
  Description of Artificial Sequence: Synthetic peptide
QQSWYDPPT

SEQ ID NO: 1012 - protein, 118 aa, Artificial Sequence; identical to SEQ ID NO: 748
  Description of Artificial Sequence: Synthetic polypeptide

SEQ ID NO: 1013 - protein, 10 aa, Artificial Sequence
  Description of Artificial Sequence: Synthetic peptide
GYTFTNYGVY

SEQ ID NO: 1014 - protein, 17 aa, Artificial Sequence
  Description of Artificial Sequence: Synthetic peptide
WINTETGKPTYADDFKG

SEQ ID NO: 1015 - protein, 9 aa, Artificial Sequence
  Description of Artificial Sequence: Synthetic peptide
ARQLDWFVY

SEQ ID NO: 1016 - protein, 107 aa, Artificial Sequence; identical to SEQ ID NO: 756
  Description of Artificial Sequence: Synthetic polypeptide

SEQ ID NO: 1017 - protein, 11 aa, Artificial Sequence
  Description of Artificial Sequence: Synthetic peptide
RARESLTTSLS

SEQ ID NO: 1018 - protein, 7 aa, Artificial Sequence
  Description of Artificial Sequence: Synthetic peptide
GASKLES

SEQ ID NO: 1019 - protein, 9 aa, Artificial Sequence
  Description of Artificial Sequence: Synthetic peptide
QQSWYDPPT

SEQ ID NO: 1020 - protein, 118 aa, Artificial Sequence; identical to SEQ ID NO: 749
  Description of Artificial Sequence: Synthetic polypeptide

SEQ ID NO: 1021 - protein, 10 aa, Artificial Sequence
  Description of Artificial Sequence: Synthetic peptide
GYTFTNYGVY

SEQ ID NO: 1022 - protein, 17 aa, Artificial Sequence
  Description of Artificial Sequence: Synthetic peptide
WINTETGKPTYADDFKG

SEQ ID NO: 1023 - protein, 9 aa, Artificial Sequence
  Description of Artificial Sequence: Synthetic peptide
ARQLDWFVY

SEQ ID NO: 1024 - protein, 107 aa, Artificial Sequence; identical to SEQ ID NO: 756
  Description of Artificial Sequence: Synthetic polypeptide

SEQ ID NO: 1025 - protein, 11 aa, Artificial Sequence
  Description of Artificial Sequence: Synthetic peptide
RARESLTTSLS

SEQ ID NO: 1026 - protein, 7 aa, Artificial Sequence
  Description of Artificial Sequence: Synthetic peptide
GASKLES

SEQ ID NO: 1027 - protein, 9 aa, Artificial Sequence
  Description of Artificial Sequence: Synthetic peptide
QQSWYDPPT

SEQ ID NO: 1028 - protein, 116 aa, Artificial Sequence; identical to SEQ ID NO: 705
  Description of Artificial Sequence: Synthetic polypeptide

SEQ ID NO: 1029 - protein, 10 aa, Artificial Sequence
  Description of Artificial Sequence: Synthetic peptide
GFTFSYYGMH

SEQ ID NO: 1030 - protein, 17 aa, Artificial Sequence
  Description of Artificial Sequence: Synthetic peptide
LIYYDSSKMYYADSVKG

SEQ ID NO: 1031 - protein, 7 aa, Artificial Sequence
  Description of Artificial Sequence: Synthetic peptide
GGTAPVY

SEQ ID NO: 1032 - protein, 106 aa, Artificial Sequence; identical to SEQ ID NO: 708
  Description of Artificial Sequence: Synthetic polypeptide

SEQ ID NO: 1033 - protein, 11 aa, Artificial Sequence
  Description of Artificial Sequence: Synthetic peptide
KGSQNIANYLA

SEQ ID NO: 1034 - protein, 7 aa, Artificial Sequence
  Description of Artificial Sequence: Synthetic peptide
NTDSLQT

SEQ ID NO: 1035 - protein, 8 aa, Artificial Sequence
  Description of Artificial Sequence: Synthetic peptide
YQSNNGYT

SEQ ID NO: 1036 - protein, 116 aa, Artificial Sequence; identical to SEQ ID NO: 705
  Description of Artificial Sequence: Synthetic polypeptide

SEQ ID NO: 1037 - protein, 10 aa, Artificial Sequence
  Description of Artificial Sequence: Synthetic peptide
GFTFSYYGMH

SEQ ID NO: 1038 - protein, 17 aa, Artificial Sequence
  Description of Artificial Sequence: Synthetic peptide
LIYYDSSKMYYADSVKG

SEQ ID NO: 1039 - protein, 7 aa, Artificial Sequence
  Description of Artificial Sequence: Synthetic peptide
GGTAPVY

SEQ ID NO: 1040 - protein, 106 aa, Artificial Sequence; identical to SEQ ID NO: 709
  Description of Artificial Sequence: Synthetic polypeptide

SEQ ID NO: 1041 - protein, 11 aa, Artificial Sequence
  Description of Artificial Sequence: Synthetic peptide
KGSQNIANYLA

SEQ ID NO: 1042 - protein, 7 aa, Artificial Sequence
  Description of Artificial Sequence: Synthetic peptide
NTDSLQT

SEQ ID NO: 1043 - protein, 8 aa, Artificial Sequence
  Description of Artificial Sequence: Synthetic peptide
YQSNNGYT

SEQ ID NO: 1044 - protein, 116 aa, Artificial Sequence; identical to SEQ ID NO: 705
  Description of Artificial Sequence: Synthetic polypeptide

SEQ ID NO: 1045 - protein, 10 aa, Artificial Sequence
  Description of Artificial Sequence: Synthetic peptide
GFTFSYYGMH

SEQ ID NO: 1046 - protein, 17 aa, Artificial Sequence
  Description of Artificial Sequence: Synthetic peptide
LIYYDSSKMYYADSVKG

SEQ ID NO: 1047 - protein, 7 aa, Artificial Sequence
  Description of Artificial Sequence: Synthetic peptide
GGTAPVY

SEQ ID NO: 1048 - protein, 106 aa, Artificial Sequence; identical to SEQ ID NO: 710
  Description of Artificial Sequence: Synthetic polypeptide

SEQ ID NO: 1049 - protein, 11 aa, Artificial Sequence
  Description of Artificial Sequence: Synthetic peptide
KGSQNIANYLA

SEQ ID NO: 1050 - protein, 7 aa, Artificial Sequence
  Description of Artificial Sequence: Synthetic peptide
NTDSLQT

SEQ ID NO: 1051 - protein, 8 aa, Artificial Sequence
  Description of Artificial Sequence: Synthetic peptide
YQSNNGYT

SEQ ID NO: 1052 - protein, 116 aa, Artificial Sequence; identical to SEQ ID NO: 705
  Description of Artificial Sequence: Synthetic polypeptide

SEQ ID NO: 1053 - protein, 10 aa, Artificial Sequence
  Description of Artificial Sequence: Synthetic peptide
GFTFSYYGMH

SEQ ID NO: 1054 - protein, 17 aa, Artificial Sequence
  Description of Artificial Sequence: Synthetic peptide
LIYYDSSKMYYADSVKG

SEQ ID NO: 1055 - protein, 7 aa, Artificial Sequence
  Description of Artificial Sequence: Synthetic peptide
GGTAPVY

SEQ ID NO: 1056 - protein, 106 aa, Artificial Sequence; identical to SEQ ID NO: 711
  Description of Artificial Sequence: Synthetic polypeptide

SEQ ID NO: 1057 - protein, 11 aa, Artificial Sequence
  Description of Artificial Sequence: Synthetic peptide
KGSQNIANYLA

SEQ ID NO: 1058 - protein, 7 aa, Artificial Sequence
  Description of Artificial Sequence: Synthetic peptide
NTDSLQT

SEQ ID NO: 1059 - protein, 8 aa, Artificial Sequence
  Description of Artificial Sequence: Synthetic peptide
YQSNNGYT

SEQ ID NO: 1060 - protein, 116 aa, Artificial Sequence; identical to SEQ ID NO: 706
  Description of Artificial Sequence: Synthetic polypeptide

SEQ ID NO: 1061 - protein, 10 aa, Artificial Sequence
  Description of Artificial Sequence: Synthetic peptide
GFTFSYYGMH

SEQ ID NO: 1062 - protein, 17 aa, Artificial Sequence
  Description of Artificial Sequence: Synthetic peptide
LIYYDSSKMYYADSVKG

SEQ ID NO: 1063 - protein, 7 aa, Artificial Sequence
  Description of Artificial Sequence: Synthetic peptide
GGTAPVY

SEQ ID NO: 1064 - protein, 106 aa, Artificial Sequence; identical to SEQ ID NO: 708
  Description of Artificial Sequence: Synthetic polypeptide

SEQ ID NO: 1065 - protein, 11 aa, Artificial Sequence
  Description of Artificial Sequence: Synthetic peptide
KGSQNIANYLA

SEQ ID NO: 1066 - protein, 7 aa, Artificial Sequence
  Description of Artificial Sequence: Synthetic peptide
NTDSLQT

SEQ ID NO: 1067 - protein, 8 aa, Artificial Sequence
  Description of Artificial Sequence: Synthetic peptide
YQSNNGYT

SEQ ID NO: 1068 - protein, 116 aa, Artificial Sequence; identical to SEQ ID NO: 706
  Description of Artificial Sequence: Synthetic polypeptide

SEQ ID NO: 1069 - protein, 10 aa, Artificial Sequence
  Description of Artificial Sequence: Synthetic peptide
GFTFSYYGMH

SEQ ID NO: 1070 - protein, 17 aa, Artificial Sequence
  Description of Artificial Sequence: Synthetic peptide
LIYYDSSKMYYADSVKG

SEQ ID NO: 1071 - protein, 7 aa, Artificial Sequence
  Description of Artificial Sequence: Synthetic peptide
GGTAPVY

SEQ ID NO: 1072 - protein, 106 aa, Artificial Sequence; identical to SEQ ID NO: 709
  Description of Artificial Sequence: Synthetic polypeptide

SEQ ID NO: 1073 - protein, 11 aa, Artificial Sequence
  Description of Artificial Sequence: Synthetic peptide
KGSQNIANYLA

SEQ ID NO: 1074 - protein, 7 aa, Artificial Sequence
  Description of Artificial Sequence: Synthetic peptide
NTDSLQT

SEQ ID NO: 1075 - protein, 8 aa, Artificial Sequence
  Description of Artificial Sequence: Synthetic peptide
YQSNNGYT

SEQ ID NO: 1076 - protein, 116 aa, Artificial Sequence; identical to SEQ ID NO: 706
  Description of Artificial Sequence: Synthetic polypeptide

SEQ ID NO: 1077 - protein, 10 aa, Artificial Sequence
  Description of Artificial Sequence: Synthetic peptide
GFTFSYYGMH

SEQ ID NO: 1078 - protein, 17 aa, Artificial Sequence
  Description of Artificial Sequence: Synthetic peptide
LIYYDSSKMYYADSVKG

SEQ ID NO: 1079 - protein, 7 aa, Artificial Sequence
  Description of Artificial Sequence: Synthetic peptide
GGTAPVY

SEQ ID NO: 1080 - protein, 106 aa, Artificial Sequence; identical to SEQ ID NO: 710
  Description of Artificial Sequence: Synthetic polypeptide

SEQ ID NO: 1081 - protein, 11 aa, Artificial Sequence
  Description of Artificial Sequence: Synthetic peptide
KGSQNIANYLA

SEQ ID NO: 1082 - protein, 7 aa, Artificial Sequence
  Description of Artificial Sequence: Synthetic peptide
NTDSLQT

SEQ ID NO: 1083 - protein, 8 aa, Artificial Sequence
  Description of Artificial Sequence: Synthetic peptide
YQSNNGYT

SEQ ID NO: 1084 - protein, 116 aa, Artificial Sequence; identical to SEQ ID NO: 706
  Description of Artificial Sequence: Synthetic polypeptide

SEQ ID NO: 1085 - protein, 10 aa, Artificial Sequence
  Description of Artificial Sequence: Synthetic peptide
GFTFSYYGMH

SEQ ID NO: 1086 - protein, 17 aa, Artificial Sequence
  Description of Artificial Sequence: Synthetic peptide
LIYYDSSKMYYADSVKG

SEQ ID NO: 1087 - protein, 7 aa, Artificial Sequence
  Description of Artificial Sequence: Synthetic peptide
GGTAPVY

SEQ ID NO: 1088 - protein, 106 aa, Artificial Sequence; identical to SEQ ID NO: 711
  Description of Artificial Sequence: Synthetic polypeptide

SEQ ID NO: 1089 - protein, 11 aa, Artificial Sequence
  Description of Artificial Sequence: Synthetic peptide
KGSQNIANYLA

SEQ ID NO: 1090 - protein, 7 aa, Artificial Sequence
  Description of Artificial Sequence: Synthetic peptide
NTDSLQT

SEQ ID NO: 1091 - protein, 8 aa, Artificial Sequence
  Description of Artificial Sequence: Synthetic peptide
YQSNNGYT

SEQ ID NO: 1092 - protein, 120 aa, Artificial Sequence; identical to SEQ ID NO: 674
  Description of Artificial Sequence: Synthetic polypeptide

SEQ ID NO: 1093 - protein, 10 aa, Artificial Sequence
  Description of Artificial Sequence: Synthetic peptide
GYTFTNYGMY

SEQ ID NO: 1094 - protein, 17 aa, Artificial Sequence
  Description of Artificial Sequence: Synthetic peptide
WINTETGKPIYADDFKG

SEQ ID NO: 1095 - protein, 11 aa, Artificial Sequence
  Description of Artificial Sequence: Synthetic peptide
VDYDGSFWFAY

SEQ ID NO: 1096 - protein, 107 aa, Artificial Sequence; identical to SEQ ID NO: 689
  Description of Artificial Sequence: Synthetic polypeptide

SEQ ID NO: 1097 - protein, 11 aa, Artificial Sequence
  Description of Artificial Sequence: Synthetic peptide
RASESVSTVIH

SEQ ID NO: 1098 - protein, 7 aa, Artificial Sequence
  Description of Artificial Sequence: Synthetic peptide
GASNLES

SEQ ID NO: 1099 - protein, 9 aa, Artificial Sequence
  Description of Artificial Sequence: Synthetic peptide
QQHWNDPPT

SEQ ID NO: 1100 - protein, 120 aa, Artificial Sequence; identical to SEQ ID NO: 25
  Description of Artificial Sequence: Synthetic polypeptide

SEQ ID NO: 1101 - protein, 10 aa, Artificial Sequence
  Description of Artificial Sequence: Synthetic peptide
GYTFTNYGMY

SEQ ID NO: 1102 - protein, 17 aa, Artificial Sequence
  Description of Artificial Sequence: Synthetic peptide
WINTETGKPIYADDFKG

SEQ ID NO: 1103 - protein, 11 aa, Artificial Sequence
  Description of Artificial Sequence: Synthetic peptide
VDYDGSFWFAY

SEQ ID NO: 1104 - protein, 107 aa, Artificial Sequence; identical to SEQ ID NO: 690
  Description of Artificial Sequence: Synthetic polypeptide

SEQ ID NO: 1105 - protein, 11 aa, Artificial Sequence
  Description of Artificial Sequence: Synthetic peptide
RASESVSTVIH

SEQ ID NO: 1106 - protein, 7 aa, Artificial Sequence
  Description of Artificial Sequence: Synthetic peptide
GASNLES

SEQ ID NO: 1107 - protein, 9 aa, Artificial Sequence
  Description of Artificial Sequence: Synthetic peptide
QQHWNDPPT

SEQ ID NO: 1108 - protein, 120 aa, Artificial Sequence; identical to SEQ ID NO: 25
  Description of Artificial Sequence: Synthetic polypeptide

SEQ ID NO: 1109 - protein, 10 aa, Artificial Sequence
  Description of Artificial Sequence: Synthetic peptide
GYTFTNYGMY

SEQ ID NO: 1110 - protein, 17 aa, Artificial Sequence
  Description of Artificial Sequence: Synthetic peptide
WINTETGKPIYADDFKG

SEQ ID NO: 1111 - protein, 11 aa, Artificial Sequence
  Description of Artificial Sequence: Synthetic peptide
VDYDGSFWFAY

SEQ ID NO: 1112 - protein, 107 aa, Artificial Sequence; identical to SEQ ID NO: 693
  Description of Artificial Sequence: Synthetic polypeptide

SEQ ID NO: 1113 - protein, 11 aa, Artificial Sequence
  Description of Artificial Sequence: Synthetic peptide
RASESVSTVIH

SEQ ID NO: 1114 - protein, 7 aa, Artificial Sequence
  Description of Artificial Sequence: Synthetic peptide
GASNLES

SEQ ID NO: 1115 - protein, 9 aa, Artificial Sequence
  Description of Artificial Sequence: Synthetic peptide
QQHWNDPPT

SEQ ID NO: 1116 - protein, 120 aa, Artificial Sequence; identical to SEQ ID NO: 25
  Description of Artificial Sequence: Synthetic polypeptide

SEQ ID NO: 1117 - protein, 10 aa, Artificial Sequence
  Description of Artificial Sequence: Synthetic peptide
GYTFTNYGMY

SEQ ID NO: 1118 - protein, 17 aa, Artificial Sequence
  Description of Artificial Sequence: Synthetic peptide
WINTETGKPIYADDFKG

SEQ ID NO: 1119 - protein, 11 aa, Artificial Sequence
  Description of Artificial Sequence: Synthetic peptide
VDYDGSFWFAY

SEQ ID NO: 1120 - protein, 107 aa, Artificial Sequence; identical to SEQ ID NO: 26
  Description of Artificial Sequence: Synthetic polypeptide

SEQ ID NO: 1121 - protein, 11 aa, Artificial Sequence
  Description of Artificial Sequence: Synthetic peptide
RASESVSTVIH

SEQ ID NO: 1122 - protein, 7 aa, Artificial Sequence
  Description of Artificial Sequence: Synthetic peptide
GASNLES

SEQ ID NO: 1123 - protein, 9 aa, Artificial Sequence
  Description of Artificial Sequence: Synthetic peptide
QQHWNDPPT

SEQ ID NO: 1124 - protein, 120 aa, Artificial Sequence; identical to SEQ ID NO: 680
  Description of Artificial Sequence: Synthetic polypeptide

SEQ ID NO: 1125 - protein, 10 aa, Artificial Sequence
  Description of Artificial Sequence: Synthetic peptide
GYTFTNYGMY

SEQ ID NO: 1126 - protein, 17 aa, Artificial Sequence
  Description of Artificial Sequence: Synthetic peptide
WINTETGKPIYADDFKG

SEQ ID NO: 1127 - protein, 11 aa, Artificial Sequence
  Description of Artificial Sequence: Synthetic peptide
VDYDGSFWFAY

SEQ ID NO: 1128 - protein, 107 aa, Artificial Sequence; identical to SEQ ID NO: 689
  Description of Artificial Sequence: Synthetic polypeptide

SEQ ID NO: 1129 - protein, 11 aa, Artificial Sequence
  Description of Artificial Sequence: Synthetic peptide
RASESVSTVIH

SEQ ID NO: 1130 - protein, 7 aa, Artificial Sequence
  Description of Artificial Sequence: Synthetic peptide
GASNLES

SEQ ID NO: 1131 - protein, 9 aa, Artificial Sequence
  Description of Artificial Sequence: Synthetic peptide
QQHWNDPPT

SEQ ID NO: 1132 - protein, 120 aa, Artificial Sequence; identical to SEQ ID NO: 680
  Description of Artificial Sequence: Synthetic polypeptide

SEQ ID NO: 1133 - protein, 10 aa, Artificial Sequence
  Description of Artificial Sequence: Synthetic peptide
GYTFTNYGMY

SEQ ID NO: 1134 - protein, 17 aa, Artificial Sequence
  Description of Artificial Sequence: Synthetic peptide
WINTETGKPIYADDFKG

SEQ ID NO: 1135 - protein, 11 aa, Artificial Sequence
  Description of Artificial Sequence: Synthetic peptide
VDYDGSFWFAY

SEQ ID NO: 1136 - protein, 107 aa, Artificial Sequence; identical to SEQ ID NO: 690
  Description of Artificial Sequence: Synthetic polypeptide

SEQ ID NO: 1137 - protein, 11 aa, Artificial Sequence
  Description of Artificial Sequence: Synthetic peptide
RASESVSTVIH

SEQ ID NO: 1138 - protein, 7 aa, Artificial Sequence
  Description of Artificial Sequence: Synthetic peptide
GASNLES

SEQ ID NO: 1139 - protein, 9 aa, Artificial Sequence
  Description of Artificial Sequence: Synthetic peptide
QQHWNDPPT

SEQ ID NO: 1140 - protein, 120 aa, Artificial Sequence; identical to SEQ ID NO: 680
  Description of Artificial Sequence: Synthetic polypeptide

SEQ ID NO: 1141 - protein, 10 aa, Artificial Sequence
  Description of Artificial Sequence: Synthetic peptide
GYTFTNYGMY

SEQ ID NO: 1142 - protein, 17 aa, Artificial Sequence
  Description of Artificial Sequence: Synthetic peptide
WINTETGKPIYADDFKG

SEQ ID NO: 1143 - protein, 11 aa, Artificial Sequence
  Description of Artificial Sequence: Synthetic peptide
VDYDGSFWFAY

SEQ ID NO: 1144 - protein, 107 aa, Artificial Sequence; identical to SEQ ID NO: 693
  Description of Artificial Sequence: Synthetic polypeptide

SEQ ID NO: 1145 - protein, 11 aa, Artificial Sequence
  Description of Artificial Sequence: Synthetic peptide
RASESVSTVIH

SEQ ID NO: 1146 - protein, 7 aa, Artificial Sequence
  Description of Artificial Sequence: Synthetic peptide
GASNLES

SEQ ID NO: 1147 - protein, 9 aa, Artificial Sequence
  Description of Artificial Sequence: Synthetic peptide
QQHWNDPPT

SEQ ID NO: 1148 - protein, 120 aa, Artificial Sequence; identical to SEQ ID NO: 680
  Description of Artificial Sequence: Synthetic polypeptide

SEQ ID NO: 1149 - protein, 10 aa, Artificial Sequence
  Description of Artificial Sequence: Synthetic peptide
GYTFTNYGMY

SEQ ID NO: 1150 - protein, 17 aa, Artificial Sequence
  Description of Artificial Sequence: Synthetic peptide
WINTETGKPIYADDFKG

SEQ ID NO: 1151 - protein, 11 aa, Artificial Sequence
  Description of Artificial Sequence: Synthetic peptide
VDYDGSFWFAY

SEQ ID NO: 1152 - protein, 107 aa, Artificial Sequence; identical to SEQ ID NO: 26
  Description of Artificial Sequence: Synthetic polypeptide

SEQ ID NO: 1153 - protein, 11 aa, Artificial Sequence
  Description of Artificial Sequence: Synthetic peptide
RASESVSTVIH

SEQ ID NO: 1154 - protein, 7 aa, Artificial Sequence
  Description of Artificial Sequence: Synthetic peptide
GASNLES

SEQ ID NO: 1155 - protein, 9 aa, Artificial Sequence
  Description of Artificial Sequence: Synthetic peptide
QQHWNDPPT

SEQ ID NO: 1156 - protein, 120 aa, Artificial Sequence; identical to SEQ ID NO: 686
  Description of Artificial Sequence: Synthetic polypeptide

SEQ ID NO: 1157 - protein, 10 aa, Artificial Sequence
  Description of Artificial Sequence: Synthetic peptide
GYTFTNYGMY

SEQ ID NO: 1158 - protein, 17 aa, Artificial Sequence
  Description of Artificial Sequence: Synthetic peptide
WINTETGKPIYADDFKG

SEQ ID NO: 1159 - protein, 11 aa, Artificial Sequence
  Description of Artificial Sequence: Synthetic peptide
VDYDGSFWFAY

SEQ ID NO: 1160 - protein, 107 aa, Artificial Sequence
  Description of Artificial Sequence: Synthetic polypeptide
ETVLTQSPATLSLSPGERATLSCRASESVSTVIHWYQQKPGQQPRLLIHGASNLESGVPARFSGSGSGTDFTLTISSLEPEDFAVYFCQQHWNDPPTFGQGTKLEIK

SEQ ID NO: 1161 - protein, 11 aa, Artificial Sequence
  Description of Artificial Sequence: Synthetic peptide
RASESVSTVIH

SEQ ID NO: 1162 - protein, 7 aa, Artificial Sequence
  Description of Artificial Sequence: Synthetic peptide
GASNLES

SEQ ID NO: 1163 - protein, 9 aa, Artificial Sequence
  Description of Artificial Sequence: Synthetic peptide
QQHWNDPPT

SEQ ID NO: 1164 - protein, 120 aa, Artificial Sequence; identical to SEQ ID NO: 674
  Description of Artificial Sequence: Synthetic polypeptide

SEQ ID NO: 1165 - protein, 10 aa, Artificial Sequence
  Description of Artificial Sequence: Synthetic peptide
GYTFTNYGMY

SEQ ID NO: 1166 - protein, 17 aa, Artificial Sequence
  Description of Artificial Sequence: Synthetic peptide
WINTETGKPIYADDFKG

SEQ ID NO: 1167 - protein, 11 aa, Artificial Sequence
  Description of Artificial Sequence: Synthetic peptide
VDYDGSFWFAY

SEQ ID NO: 1168 - protein, 107 aa, Artificial Sequence; identical to SEQ ID NO: 690
  Description of Artificial Sequence: Synthetic polypeptide

SEQ ID NO: 1169 - protein, 11 aa, Artificial Sequence
  Description of Artificial Sequence: Synthetic peptide
RASESVSTVIH

SEQ ID NO: 1170 - protein, 7 aa, Artificial Sequence
  Description of Artificial Sequence: Synthetic peptide
GASNLES

SEQ ID NO: 1171 - protein, 9 aa, Artificial Sequence
  Description of Artificial Sequence: Synthetic peptide
QQHWNDPPT

SEQ ID NO: 1172 - protein, 120 aa, Artificial Sequence; identical to SEQ ID NO: 682
  Description of Artificial Sequence: Synthetic polypeptide

SEQ ID NO: 1173 - protein, 10 aa, Artificial Sequence
  Description of Artificial Sequence: Synthetic peptide
GYTFTNYGMY

SEQ ID NO: 1174 - protein, 17 aa, Artificial Sequence
  Description of Artificial Sequence: Synthetic peptide
WINTETGKPIYADDFKG

SEQ ID NO: 1175 - protein, 11 aa, Artificial Sequence
  Description of Artificial Sequence: Synthetic peptide
VDYDGSFWFAY

SEQ ID NO: 1176 - protein, 107 aa, Artificial Sequence; identical to SEQ ID NO: 1160
  Description of Artificial Sequence: Synthetic polypeptide

SEQ ID NO: 1177 - protein, 11 aa, Artificial Sequence
  Description of Artificial Sequence: Synthetic peptide
RASESVSTVIH

SEQ ID NO: 1178 - protein, 7 aa, Artificial Sequence
  Description of Artificial Sequence: Synthetic peptide
GASNLES

SEQ ID NO: 1179 - protein, 9 aa, Artificial Sequence
  Description of Artificial Sequence: Synthetic peptide
QQHWNDPPT

SEQ ID NO: 1180 - protein, 120 aa, Artificial Sequence; identical to SEQ ID NO: 683
  Description of Artificial Sequence: Synthetic polypeptide

SEQ ID NO: 1181 - protein, 10 aa, Artificial Sequence
  Description of Artificial Sequence: Synthetic peptide
GYTFTNYGMY

SEQ ID NO: 1182 - protein, 17 aa, Artificial Sequence
  Description of Artificial Sequence: Synthetic peptide
WINTETGKPIYADDFKG

SEQ ID NO: 1183 - protein, 11 aa, Artificial Sequence
  Description of Artificial Sequence: Synthetic peptide
VDYDGSFWFAY

SEQ ID NO: 1184 - protein, 107 aa, Artificial Sequence; identical to SEQ ID NO: 1160
  Description of Artificial Sequence: Synthetic polypeptide

SEQ ID NO: 1185 - protein, 11 aa, Artificial Sequence
  Description of Artificial Sequence: Synthetic peptide
RASESVSTVIH

SEQ ID NO: 1186 - protein, 7 aa, Artificial Sequence
  Description of Artificial Sequence: Synthetic peptide
GASNLES

SEQ ID NO: 1187 - protein, 9 aa, Artificial Sequence
  Description of Artificial Sequence: Synthetic peptide
QQHWNDPPT

SEQ ID NO: 1188 - protein, 120 aa, Artificial Sequence; identical to SEQ ID NO: 674
  Description of Artificial Sequence: Synthetic polypeptide

SEQ ID NO: 1189 - protein, 10 aa, Artificial Sequence
  Description of Artificial Sequence: Synthetic peptide
GYTFTNYGMY

SEQ ID NO: 1190 - protein, 17 aa, Artificial Sequence
  Description of Artificial Sequence: Synthetic peptide
WINTETGKPIYADDFKG

SEQ ID NO: 1191 - protein, 11 aa, Artificial Sequence
  Description of Artificial Sequence: Synthetic peptide
VDYDGSFWFAY

SEQ ID NO: 1192 - protein, 107 aa, Artificial Sequence; identical to SEQ ID NO: 693
  Description of Artificial Sequence: Synthetic polypeptide

SEQ ID NO: 1193 - protein, 11 aa, Artificial Sequence
  Description of Artificial Sequence: Synthetic peptide
RASESVSTVIH

SEQ ID NO: 1194 - protein, 7 aa, Artificial Sequence
  Description of Artificial Sequence: Synthetic peptide
GASNLES

SEQ ID NO: 1195 - protein, 9 aa, Artificial Sequence
  Description of Artificial Sequence: Synthetic peptide
QQHWNDPPT

SEQ ID NO: 1196 - protein, 120 aa, Artificial Sequence; identical to SEQ ID NO: 674
  Description of Artificial Sequence: Synthetic polypeptide

SEQ ID NO: 1197 - protein, 10 aa, Artificial Sequence
  Description of Artificial Sequence: Synthetic peptide
GYTFTNYGMY

SEQ ID NO: 1198 - protein, 17 aa, Artificial Sequence
  Description of Artificial Sequence: Synthetic peptide
WINTETGKPIYADDFKG

SEQ ID NO: 1199 - protein, 11 aa, Artificial Sequence
  Description of Artificial Sequence: Synthetic peptide
VDYDGSFWFAY

SEQ ID NO: 1200 - protein, 107 aa, Artificial Sequence; identical to SEQ ID NO: 26
  Description of Artificial Sequence: Synthetic polypeptide

SEQ ID NO: 1201 - protein, 11 aa, Artificial Sequence
  Description of Artificial Sequence: Synthetic peptide
RASESVSTVIH

SEQ ID NO: 1202 - protein, 7 aa, Artificial Sequence
  Description of Artificial Sequence: Synthetic peptide
GASNLES

SEQ ID NO: 1203 - protein, 9 aa, Artificial Sequence
  Description of Artificial Sequence: Synthetic peptide
QQHWNDPPT

SEQ ID NO: 1204 - protein, 120 aa, Artificial Sequence; identical to SEQ ID NO: 675
  Description of Artificial Sequence: Synthetic polypeptide

SEQ ID NO: 1205 - protein, 10 aa, Artificial Sequence
  Description of Artificial Sequence: Synthetic peptide
GYTFTNYGMY

SEQ ID NO: 1206 - protein, 17 aa, Artificial Sequence
  Description of Artificial Sequence: Synthetic peptide
WINTETGKPIYADDFKG

SEQ ID NO: 1207 - protein, 11 aa, Artificial Sequence
  Description of Artificial Sequence: Synthetic peptide
VDYDGSFWFAY

SEQ ID NO: 1208 - protein, 107 aa, Artificial Sequence; identical to SEQ ID NO: 689
  Description of Artificial Sequence: Synthetic polypeptide

SEQ ID NO: 1209 - protein, 11 aa, Artificial Sequence
  Description of Artificial Sequence: Synthetic peptide
RASESVSTVIH

SEQ ID NO: 1210 - protein, 7 aa, Artificial Sequence
  Description of Artificial Sequence: Synthetic peptide
GASNLES

SEQ ID NO: 1211 - protein, 9 aa, Artificial Sequence
  Description of Artificial Sequence: Synthetic peptide
QQHWNDPPT

SEQ ID NO: 1212 - protein, 120 aa, Artificial Sequence; identical to SEQ ID NO: 675
  Description of Artificial Sequence: Synthetic polypeptide

SEQ ID NO: 1213 - protein, 10 aa, Artificial Sequence
  Description of Artificial Sequence: Synthetic peptide
GYTFTNYGMY

SEQ ID NO: 1214 - protein, 17 aa, Artificial Sequence
  Description of Artificial Sequence: Synthetic peptide
WINTETGKPIYADDFKG

SEQ ID NO: 1215 - protein, 11 aa, Artificial Sequence
  Description of Artificial Sequence: Synthetic peptide
VDYDGSFWFAY

SEQ ID NO: 1216 - protein, 107 aa, Artificial Sequence; identical to SEQ ID NO: 690
  Description of Artificial Sequence: Synthetic polypeptide

SEQ ID NO: 1217 - protein, 11 aa, Artificial Sequence
  Description of Artificial Sequence: Synthetic peptide
RASESVSTVIH

SEQ ID NO: 1218 - protein, 7 aa, Artificial Sequence
  Description of Artificial Sequence: Synthetic peptide
GASNLES

SEQ ID NO: 1219 - protein, 9 aa, Artificial Sequence
  Description of Artificial Sequence: Synthetic peptide
QQHWNDPPT

SEQ ID NO: 1220 - protein, 120 aa, Artificial Sequence; identical to SEQ ID NO: 675
  Description of Artificial Sequence: Synthetic polypeptide

SEQ ID NO: 1221 - protein, 10 aa, Artificial Sequence
  Description of Artificial Sequence: Synthetic peptide
GYTFTNYGMY

SEQ ID NO: 1222 - protein, 17 aa, Artificial Sequence
  Description of Artificial Sequence: Synthetic peptide
WINTETGKPIYADDFKG

SEQ ID NO: 1223 - protein, 11 aa, Artificial Sequence
  Description of Artificial Sequence: Synthetic peptide
VDYDGSFWFAY

SEQ ID NO: 1224 - protein, 107 aa, Artificial Sequence; identical to SEQ ID NO: 693
  Description of Artificial Sequence: Synthetic polypeptide

SEQ ID NO: 1225 - protein, 11 aa, Artificial Sequence
  Description of Artificial Sequence: Synthetic peptide
RASESVSTVIH

SEQ ID NO: 1226 - protein, 7 aa, Artificial Sequence
  Description of Artificial Sequence: Synthetic peptide
GASNLES

SEQ ID NO: 1227 - protein, 9 aa, Artificial Sequence
  Description of Artificial Sequence: Synthetic peptide
QQHWNDPPT

SEQ ID NO: 1228 - protein, 120 aa, Artificial Sequence; identical to SEQ ID NO: 675
  Description of Artificial Sequence: Synthetic polypeptide

SEQ ID NO: 1229 - protein, 10 aa, Artificial Sequence
  Description of Artificial Sequence: Synthetic peptide
GYTFTNYGMY

SEQ ID NO: 1230 - protein, 17 aa, Artificial Sequence
  Description of Artificial Sequence: Synthetic peptide
WINTETGKPIYADDFKG

SEQ ID NO: 1231 - protein, 11 aa, Artificial Sequence
  Description of Artificial Sequence: Synthetic peptide
VDYDGSFWFAY

SEQ ID NO: 1232 - protein, 107 aa, Artificial Sequence; identical to SEQ ID NO: 26
  Description of Artificial Sequence: Synthetic polypeptide

SEQ ID NO: 1233 - protein, 11 aa, Artificial Sequence
  Description of Artificial Sequence: Synthetic peptide
RASESVSTVIH

SEQ ID NO: 1234 - protein, 7 aa, Artificial Sequence
  Description of Artificial Sequence: Synthetic peptide
GASNLES

SEQ ID NO: 1235 - protein, 9 aa, Artificial Sequence
  Description of Artificial Sequence: Synthetic peptide
QQHWNDPPT

SEQ ID NO: 1236 - protein, 120 aa, Artificial Sequence; identical to SEQ ID NO: 25
  Description of Artificial Sequence: Synthetic polypeptide

SEQ ID NO: 1237 - protein, 10 aa, Artificial Sequence
  Description of Artificial Sequence: Synthetic peptide
GYTFTNYGMY

SEQ ID NO: 1238 - protein, 17 aa, Artificial Sequence
  Description of Artificial Sequence: Synthetic peptide
WINTETGKPIYADDFKG

SEQ ID NO: 1239 - protein, 11 aa, Artificial Sequence
  Description of Artificial Sequence: Synthetic peptide
VDYDGSFWFAY

SEQ ID NO: 1240 - protein, 107 aa, Artificial Sequence; identical to SEQ ID NO: 689
  Description of Artificial Sequence: Synthetic polypeptide

SEQ ID NO: 1241 - protein, 11 aa, Artificial Sequence
  Description of Artificial Sequence: Synthetic peptide
RASESVSTVIH

SEQ ID NO: 1242 - protein, 7 aa, Artificial Sequence
  Description of Artificial Sequence: Synthetic peptide
GASNLES

SEQ ID NO: 1243 - protein, 9 aa, Artificial Sequence
  Description of Artificial Sequence: Synthetic peptide
QQHWNDPPT

SEQ ID NO: 1244 - protein, 124 aa, Artificial Sequence; identical to SEQ ID NO: 35
  Description of Artificial Sequence: Synthetic polypeptide

SEQ ID NO: 1245 - protein, 10 aa, Artificial Sequence
  Description of Artificial Sequence: Synthetic peptide
GYTFTNYGMY

SEQ ID NO: 1246 - protein, 17 aa, Artificial Sequence
  Description of Artificial Sequence: Synthetic peptide
WIDTETGRPTYADDFKG

SEQ ID NO: 1247 - protein, 15 aa, Artificial Sequence
  Description of Artificial Sequence: Synthetic peptide
WSGDTTGIRGPWFAY

SEQ ID NO: 1248 - protein, 107 aa, Artificial Sequence; identical to SEQ ID NO: 36
  Description of Artificial Sequence: Synthetic polypeptide

SEQ ID NO: 1249 - protein, 11 aa, Artificial Sequence
  Description of Artificial Sequence: Synthetic peptide
LASEDIYSDLA

SEQ ID NO: 1250 - protein, 7 aa, Artificial Sequence
  Description of Artificial Sequence: Synthetic peptide
NANGLQN

SEQ ID NO: 1251 - protein, 9 aa, Artificial Sequence
  Description of Artificial Sequence: Synthetic peptide
QQYNYFPGT

SEQ ID NO: 1252 - protein, 124 aa, Artificial Sequence; identical to SEQ ID NO: 764
  Description of Artificial Sequence: Synthetic polypeptide

SEQ ID NO: 1253 - protein, 10 aa, Artificial Sequence
  Description of Artificial Sequence: Synthetic peptide
GYTFTNYGMY

SEQ ID NO: 1254 - protein, 17 aa, Artificial Sequence
  Description of Artificial Sequence: Synthetic peptide
WIDTETGRPTYADDFKG

SEQ ID NO: 1255 - protein, 15 aa, Artificial Sequence
  Description of Artificial Sequence: Synthetic peptide
WSGDTTGIRGPWFAY

SEQ ID NO: 1256 - protein, 107 aa, Artificial Sequence; identical to SEQ ID NO: 36
  Description of Artificial Sequence: Synthetic polypeptide

SEQ ID NO: 1257 - protein, 11 aa, Artificial Sequence
  Description of Artificial Sequence: Synthetic peptide
LASEDIYSDLA

SEQ ID NO: 1258 - protein, 7 aa, Artificial Sequence
  Description of Artificial Sequence: Synthetic peptide
NANGLQN

SEQ ID NO: 1259 - protein, 9 aa, Artificial Sequence
  Description of Artificial Sequence: Synthetic peptide
QQYNYFPGT

SEQ ID NO: 1260 - protein, 124 aa, Artificial Sequence; identical to SEQ ID NO: 37
  Description of Artificial Sequence: Synthetic polypeptide

SEQ ID NO: 1261 - protein, 10 aa, Artificial Sequence
  Description of Artificial Sequence: Synthetic peptide
GYTFTNYGMY

SEQ ID NO: 1262 - protein, 17 aa, Artificial Sequence
  Description of Artificial Sequence: Synthetic peptide
WIDTETGRPTYADDFKG

SEQ ID NO: 1263 - protein, 15 aa, Artificial Sequence
  Description of Artificial Sequence: Synthetic peptide
WSGDTTGIRGPWFAY

SEQ ID NO: 1264 - protein, 107 aa, Artificial Sequence; identical to SEQ ID NO: 36
  Description of Artificial Sequence: Synthetic polypeptide

SEQ ID NO: 1265 - protein, 11 aa, Artificial Sequence
  Description of Artificial Sequence: Synthetic peptide
LASEDIYSDLA

SEQ ID NO: 1266 - protein, 7 aa, Artificial Sequence
  Description of Artificial Sequence: Synthetic peptide
NANGLQN

SEQ ID NO: 1267 - protein, 9 aa, Artificial Sequence
  Description of Artificial Sequence: Synthetic peptide
QQYNYFPGT

SEQ ID NO: 1268 - protein, 124 aa, Artificial Sequence; identical to SEQ ID NO: 35
  Description of Artificial Sequence: Synthetic polypeptide

SEQ ID NO: 1269 - protein, 10 aa, Artificial Sequence
  Description of Artificial Sequence: Synthetic peptide
GYTFTNYGMY

SEQ ID NO: 1270 - protein, 17 aa, Artificial Sequence
  Description of Artificial Sequence: Synthetic peptide
WIDTETGRPTYADDFKG

SEQ ID NO: 1271 - protein, 15 aa, Artificial Sequence
  Description of Artificial Sequence: Synthetic peptide
WSGDTTGIRGPWFAY

SEQ ID NO: 1272 - protein, 107 aa, Artificial Sequence; identical to SEQ ID NO: 38
  Description of Artificial Sequence: Synthetic polypeptide

SEQ ID NO: 1273 - protein, 11 aa, Artificial Sequence
  Description of Artificial Sequence: Synthetic peptide
LASEDIYSDLA

SEQ ID NO: 1274 - protein, 7 aa, Artificial Sequence
  Description of Artificial Sequence: Synthetic peptide
NANGLQN

SEQ ID NO: 1275 - protein, 9 aa, Artificial Sequence
  Description of Artificial Sequence: Synthetic peptide
QQYNYFPGT

SEQ ID NO: 1276 - protein, 124 aa, Artificial Sequence; identical to SEQ ID NO: 764
  Description of Artificial Sequence: Synthetic polypeptide

SEQ ID NO: 1277 - protein, 10 aa, Artificial Sequence
  Description of Artificial Sequence: Synthetic peptide
GYTFTNYGMY

SEQ ID NO: 1278 - protein, 17 aa, Artificial Sequence
  Description of Artificial Sequence: Synthetic peptide
WIDTETGRPTYADDFKG

SEQ ID NO: 1279 - protein, 15 aa, Artificial Sequence
  Description of Artificial Sequence: Synthetic peptide
WSGDTTGIRGPWFAY

SEQ ID NO: 1280 - protein, 107 aa, Artificial Sequence; identical to SEQ ID NO: 38
  Description of Artificial Sequence: Synthetic polypeptide

SEQ ID NO: 1281 - protein, 11 aa, Artificial Sequence
  Description of Artificial Sequence: Synthetic peptide
LASEDIYSDLA

SEQ ID NO: 1282 - protein, 7 aa, Artificial Sequence
  Description of Artificial Sequence: Synthetic peptide
NANGLQN

SEQ ID NO: 1283 - protein, 9 aa, Artificial Sequence
  Description of Artificial Sequence: Synthetic peptide
QQYNYFPGT

SEQ ID NO: 1284 - protein, 124 aa, Artificial Sequence; identical to SEQ ID NO: 37
  Description of Artificial Sequence: Synthetic polypeptide

SEQ ID NO: 1285 - protein, 10 aa, Artificial Sequence
  Description of Artificial Sequence: Synthetic peptide
GYTFTNYGMY

SEQ ID NO: 1286 - protein, 17 aa, Artificial Sequence
  Description of Artificial Sequence: Synthetic peptide
WIDTETGRPTYADDFKG

SEQ ID NO: 1287 - protein, 15 aa, Artificial Sequence
  Description of Artificial Sequence: Synthetic peptide
WSGDTTGIRGPWFAY

SEQ ID NO: 1288 - protein, 107 aa, Artificial Sequence; identical to SEQ ID NO: 38
  Description of Artificial Sequence: Synthetic polypeptide

SEQ ID NO: 1289 - protein, 11 aa, Artificial Sequence
  Description of Artificial Sequence: Synthetic peptide
LASEDIYSDLA

SEQ ID NO: 1290 - protein, 7 aa, Artificial Sequence
  Description of Artificial Sequence: Synthetic peptide
NANGLQN

SEQ ID NO: 1291 - protein, 9 aa, Artificial Sequence
  Description of Artificial Sequence: Synthetic peptide
QQYNYFPGT

SEQ ID NO: 1292 - protein, 123 aa, Artificial Sequence [sequence omitted]

SEQ ID NO: 1293 - protein, 10 aa, Artificial Sequence
  Description of Artificial Sequence: Synthetic peptide
GYTFTNYGMN

SEQ ID NO: 1294 - protein, 17 aa, Artificial Sequence
  Description of Artificial Sequence: Synthetic peptide
WINTYTGEPTYAADFKR

SEQ ID NO: 1295 - protein, 14 aa, Artificial Sequence
  Description of Artificial Sequence: Synthetic peptide
YPHYYGSSHWYFDV

SEQ ID NO: 1296 - protein, 107 aa, Artificial Sequence [sequence omitted]

SEQ ID NO: 1297 - protein, 11 aa, Artificial Sequence
  Description of Artificial Sequence: Synthetic peptide
SASQDISNYLN

SEQ ID NO: 1298 - protein, 7 aa, Artificial Sequence
  Description of Artificial Sequence: Synthetic peptide
FTSSLHS

SEQ ID NO: 1299 - protein, 9 aa, Artificial Sequence
  Description of Artificial Sequence: Synthetic peptide
QQYSTVPWT

SEQ ID NO: 1300 - protein, 123 aa, Artificial Sequence
  Description of Artificial Sequence: Synthetic polypeptide
EVQLVQSGAEVKKPGSSVKVSCKASGYTFTDYVMHWVRQAPGQGLEWMGTIIPLIDTTSYNQKFKGRVTITADKSTSTAYMELSSLRSEDTAVYYCARTSPYYYSSYDVMDAWGQGTTVTVSS

SEQ ID NO: 1301 - protein, 10 aa, Artificial Sequence
  Description of Artificial Sequence: Synthetic peptide
GYTFTDYVMH

SEQ ID NO: 1302 - protein, 17 aa, Artificial Sequence
  Description of Artificial Sequence: Synthetic peptide
TIIPLIDTTSYNQKFKG

SEQ ID NO: 1303 - protein, 14 aa, Artificial Sequence
  Description of Artificial Sequence: Synthetic peptide
TSPYYYSSYDVMDA

SEQ ID NO: 1304 - protein, 106 aa, Artificial Sequence
  Description of Artificial Sequence: Synthetic polypeptide
AIQLTQSPSSLSASVGDRVTITCKGSQNINNYLAWYQQKPGKAPKLLIYKTNNLQTGVPSRFSGSGSGTDFTLTISSLQPEDFATYYCYQYDNGYTFGQGTKLEIK

SEQ ID NO: 1305 - protein, 11 aa, Artificial Sequence
  Description of Artificial Sequence: Synthetic peptide
KGSQNINNYLA

SEQ ID NO: 1306 - protein, 7 aa, Artificial Sequence
  Description of Artificial Sequence: Synthetic peptide
KTNNLQT

SEQ ID NO: 1307 - protein, 8 aa, Artificial Sequence
  Description of Artificial Sequence: Synthetic peptide
YQYDNGYT

SEQ ID NO: 1308 - protein, 123 aa, Artificial Sequence
  Description of Artificial Sequence: Synthetic polypeptide
EVQLVQSGAEVKKPGSSVKVSCKASGYTFTDYVMHWVRQAPGQGLEWIGTIIPLIDTTSYNQKFKGRVTITADKSTSTAYMELSSLRSEDTAVYYCARTSPYYYSSYDVMDAWGQGTTVTVSS

SEQ ID NO: 1309 - protein, 10 aa, Artificial Sequence
  Description of Artificial Sequence: Synthetic peptide
GYTFTDYVMH

SEQ ID NO: 1310 - protein, 17 aa, Artificial Sequence
  Description of Artificial Sequence: Synthetic peptide
TIIPLIDTTSYNQKFKG

SEQ ID NO: 1311 - protein, 14 aa, Artificial Sequence
  Description of Artificial Sequence: Synthetic peptide
TSPYYYSSYDVMDA

SEQ ID NO: 1312 - protein, 106 aa, Artificial Sequence
  Description of Artificial Sequence: Synthetic polypeptide
AIQLTQSPSSLSASVGDRVTITCKGSQNINNYLAWYQQKPGKAPKLLIYKTNNLQTGIPSRFSGSGSGTDYTLTISSLQPEDFATYYCYQYDNGYTFGQGTKLEIK

SEQ ID NO: 1313 - protein, 11 aa, Artificial Sequence
  Description of Artificial Sequence: Synthetic peptide
KGSQNINNYLA

SEQ ID NO: 1314 - protein, 7 aa, Artificial Sequence
  Description of Artificial Sequence: Synthetic peptide
KTNNLQT

SEQ ID NO: 1315 - protein, 8 aa, Artificial Sequence
  Description of Artificial Sequence: Synthetic peptide
YQYDNGYT

SEQ ID NO: 1316 - protein, 123 aa, Artificial Sequence; identical to SEQ ID NO: 1308
  Description of Artificial Sequence: Synthetic polypeptide

SEQ ID NO: 1317 - protein, 10 aa, Artificial Sequence
  Description of Artificial Sequence: Synthetic peptide
GYTFTDYVMH

SEQ ID NO: 1318 - protein, 17 aa, Artificial Sequence
  Description of Artificial Sequence: Synthetic peptide
TIIPLIDTTSYNQKFKG

SEQ ID NO: 1319 - protein, 14 aa, Artificial Sequence
  Description of Artificial Sequence: Synthetic peptide
TSPYYYSSYDVMDA

SEQ ID NO: 1320 - protein, 106 aa, Artificial Sequence
  Description of Artificial Sequence: Synthetic polypeptide
EIVLTQSPATLSLSPGERATLSCKGSQNINNYLAWYQQKPGQAPRLLIYKTNNLQTGIPARFSGSGSGTDFTLTISSLEPEDFAVYYCYQYDNGYTFGQGTKLEIK

SEQ ID NO: 1321 - protein, 11 aa, Artificial Sequence
  Description of Artificial Sequence: Synthetic peptide
KGSQNINNYLA

SEQ ID NO: 1322 - protein, 7 aa, Artificial Sequence
  Description of Artificial Sequence: Synthetic peptide
KTNNLQT

SEQ ID NO: 1323 - protein, 8 aa, Artificial Sequence
  Description of Artificial Sequence: Synthetic peptide
YQYDNGYT

SEQ ID NO: 1324 - protein, 123 aa, Artificial Sequence; identical to SEQ ID NO: 1308
  Description of Artificial Sequence: Synthetic polypeptide

SEQ ID NO: 1325 - protein, 10 aa, Artificial Sequence
  Description of Artificial Sequence: Synthetic peptide
GYTFTDYVMH

SEQ ID NO: 1326 - protein, 17 aa, Artificial Sequence
  Description of Artificial Sequence: Synthetic peptide
TIIPLIDTTSYNQKFKG

SEQ ID NO: 1327 - protein, 14 aa, Artificial Sequence
  Description of Artificial Sequence: Synthetic peptide
TSPYYYSSYDVMDA

SEQ ID NO: 1328 - protein, 106 aa, Artificial Sequence
  Description of Artificial Sequence: Synthetic polypeptide
EIVLTQSPATLSLSPGERATLSCKGSQNINNYLAWYQQKPGQAPRLLIYKTNNLQTGIPARFSGSGSGTDYTLTISSLEPEDFATYYCYQYDNGYTFGQGTKLEIK

SEQ ID NO: 1329 - protein, 11 aa, Artificial Sequence
  Description of Artificial Sequence: Synthetic peptide
KGSQNINNYLA

SEQ ID NO: 1330 - protein, 7 aa, Artificial Sequence
  Description of Artificial Sequence: Synthetic peptide
KTNNLQT

SEQ ID NO: 1331 - protein, 8 aa, Artificial Sequence
  Description of Artificial Sequence: Synthetic peptide
YQYDNGYT

SEQ ID NO: 1332 - protein, 123 aa, Artificial Sequence; identical to SEQ ID NO: 1300
  Description of Artificial Sequence: Synthetic polypeptide

SEQ ID NO: 1333 - protein, 10 aa, Artificial Sequence
  Description of Artificial Sequence: Synthetic peptide
GYTFTDYVMH

SEQ ID NO: 1334 - protein, 17 aa, Artificial Sequence
  Description of Artificial Sequence: Synthetic peptide
TIIPLIDTTSYNQKFKG

SEQ ID NO: 1335 - protein, 14 aa, Artificial Sequence
  Description of Artificial Sequence: Synthetic peptide
TSPYYYSSYDVMDA

SEQ ID NO: 1336 - protein, 106 aa, Artificial Sequence; identical to SEQ ID NO: 1312
  Description of Artificial Sequence: Synthetic polypeptide

SEQ ID NO: 1337 - protein, 11 aa, Artificial Sequence
  Description of Artificial Sequence: Synthetic peptide
KGSQNINNYLA

SEQ ID NO: 1338 - protein, 7 aa, Artificial Sequence
  Description of Artificial Sequence: Synthetic peptide
KTNNLQT

SEQ ID NO: 1339 - protein, 8 aa, Artificial Sequence
  Description of Artificial Sequence: Synthetic peptide
YQYDNGYT

SEQ ID NO: 1340 - protein, 123 aa, Artificial Sequence; identical to SEQ ID NO: 1300
  Description of Artificial Sequence: Synthetic polypeptide

SEQ ID NO: 1341 - protein, 10 aa, Artificial Sequence
  Description of Artificial Sequence: Synthetic peptide
GYTFTDYVMH

SEQ ID NO: 1342 - protein, 17 aa, Artificial Sequence
  Description of Artificial Sequence: Synthetic peptide
TIIPLIDTTSYNQKFKG

SEQ ID NO: 1343 - protein, 14 aa, Artificial Sequence
  Description of Artificial Sequence: Synthetic peptide
TSPYYYSSYDVMDA

SEQ ID NO: 1344 - protein, 106 aa, Artificial Sequence; identical to SEQ ID NO: 1320
  Description of Artificial Sequence: Synthetic polypeptide

SEQ ID NO: 1345 - protein, 11 aa, Artificial Sequence
  Description of Artificial Sequence: Synthetic peptide
KGSQNINNYLA

SEQ ID NO: 1346 - protein, 7 aa, Artificial Sequence
  Description of Artificial Sequence: Synthetic peptide
KTNNLQT

SEQ ID NO: 1347 - protein, 8 aa, Artificial Sequence
  Description of Artificial Sequence: Synthetic peptide
YQYDNGYT

SEQ ID NO: 1348 - protein, 123 aa, Artificial Sequence; identical to SEQ ID NO: 1300
  Description of Artificial Sequence: Synthetic polypeptide

SEQ ID NO: 1349 - protein, 10 aa, Artificial Sequence
  Description of Artificial Sequence: Synthetic peptide
GYTFTDYVMH

SEQ ID NO: 1350 - protein, 17 aa, Artificial Sequence
  Description of Artificial Sequence: Synthetic peptide
TIIPLIDTTSYNQKFKG

SEQ ID NO: 1351 - protein, 14 aa, Artificial Sequence
  Description of Artificial Sequence: Synthetic peptide
TSPYYYSSYDVMDA

SEQ ID NO: 1352 - protein, 106 aa, Artificial Sequence; identical to SEQ ID NO: 1328
  Description of Artificial Sequence: Synthetic polypeptide

SEQ ID NO: 1353 - protein, 11 aa, Artificial Sequence
  Description of Artificial Sequence: Synthetic peptide
KGSQNINNYLA

SEQ ID NO: 1354 - protein, 7 aa, Artificial Sequence
  Description of Artificial Sequence: Synthetic peptide
KTNNLQT

SEQ ID NO: 1355 - protein, 8 aa, Artificial Sequence
  Description of Artificial Sequence: Synthetic peptide
YQYDNGYT

SEQ ID NO: 1356 - protein, 123 aa, Artificial Sequence
  Description of Artificial Sequence: Synthetic polypeptide
EVQLVQSGAEVKKPGSSVKVSCKASGYTFTDYVMHWVRQAPGQGLEWIGTIIPLIDTTSYNQKFKGRATLTADKSTNTAYMELSSLRSEDTAVYYCARTSPYYYSSYDVMDAWGQGTTVTVSS

SEQ ID NO: 1357 - protein, 10 aa, Artificial Sequence
  Description of Artificial Sequence: Synthetic peptide
GYTFTDYVMH

SEQ ID NO: 1358 - protein, 17 aa, Artificial Sequence
  Description of Artificial Sequence: Synthetic peptide
TIIPLIDTTSYNQKFKG

SEQ ID NO: 1359 - protein, 14 aa, Artificial Sequence
  Description of Artificial Sequence: Synthetic peptide
TSPYYYSSYDVMDA

SEQ ID NO: 1360 - protein, 106 aa, Artificial Sequence; identical to SEQ ID NO: 1304
  Description of Artificial Sequence: Synthetic polypeptide

SEQ ID NO: 1361 - protein, 11 aa, Artificial Sequence
  Description of Artificial Sequence: Synthetic peptide
KGSQNINNYLA

SEQ ID NO: 1362 - protein, 7 aa, Artificial Sequence
  Description of Artificial Sequence: Synthetic peptide
KTNNLQT

SEQ ID NO: 1363 - protein, 8 aa, Artificial Sequence
  Description of Artificial Sequence: Synthetic peptide
YQYDNGYT

SEQ ID NO: 1364 - protein, 123 aa, Artificial Sequence; identical to SEQ ID NO: 1356
  Description of Artificial Sequence: Synthetic polypeptide

SEQ ID NO: 1365 - protein, 10 aa, Artificial Sequence
  Description of Artificial Sequence: Synthetic peptide
GYTFTDYVMH

SEQ ID NO: 1366 - protein, 17 aa, Artificial Sequence
  Description of Artificial Sequence: Synthetic peptide
TIIPLIDTTSYNQKFKG

SEQ ID NO: 1367 - protein, 14 aa, Artificial Sequence
  Description of Artificial Sequence: Synthetic peptide
TSPYYYSSYDVMDA

SEQ ID NO: 1368 - protein, 106 aa, Artificial Sequence; identical to SEQ ID NO: 1312
  Description of Artificial Sequence: Synthetic polypeptide

SEQ ID NO: 1369 - protein, 11 aa, Artificial Sequence
  Description of Artificial Sequence: Synthetic peptide
KGSQNINNYLA

SEQ ID NO: 1370 - protein, 7 aa, Artificial Sequence
  Description of Artificial Sequence: Synthetic peptide
KTNNLQT

SEQ ID NO: 1371 - protein, 8 aa, Artificial Sequence
  Description of Artificial Sequence: Synthetic peptide
YQYDNGYT

SEQ ID NO: 1372 - protein, 123 aa, Artificial Sequence; identical to SEQ ID NO: 1356
  Description of Artificial Sequence: Synthetic polypeptide

SEQ ID NO: 1373 - protein, 10 aa, Artificial Sequence
  Description of Artificial Sequence: Synthetic peptide
GYTFTDYVMH

SEQ ID NO: 1374 - protein, 17 aa, Artificial Sequence
  Description of Artificial Sequence: Synthetic peptide
TIIPLIDTTSYNQKFKG

SEQ ID NO: 1375 - protein, 14 aa, Artificial Sequence
  Description of Artificial Sequence: Synthetic peptide
TSPYYYSSYDVMDA

SEQ ID NO: 1376 - protein, 106 aa, Artificial Sequence; identical to SEQ ID NO: 1320
  Description of Artificial Sequence: Synthetic polypeptide

SEQ ID NO: 1377 - protein, 11 aa, Artificial Sequence
  Description of Artificial Sequence: Synthetic peptide
KGSQNINNYLA

SEQ ID NO: 1378 - protein, 7 aa, Artificial Sequence
  Description of Artificial Sequence: Synthetic peptide
KTNNLQT

SEQ ID NO: 1379 - protein, 8 aa, Artificial Sequence
  Description of Artificial Sequence: Synthetic peptide
YQYDNGYT

SEQ ID NO: 1380 - protein, 123 aa, Artificial Sequence; identical to SEQ ID NO: 1356
  Description of Artificial Sequence: Synthetic polypeptide

SEQ ID NO: 1381 - protein, 10 aa, Artificial Sequence
  Description of Artificial Sequence: Synthetic peptide
GYTFTDYVMH

SEQ ID NO: 1382 - protein, 17 aa, Artificial Sequence
  Description of Artificial Sequence: Synthetic peptide
TIIPLIDTTSYNQKFKG

SEQ ID NO: 1383 - protein, 14 aa, Artificial Sequence
  Description of Artificial Sequence: Synthetic peptide
TSPYYYSSYDVMDA

SEQ ID NO: 1384 - protein, 106 aa, Artificial Sequence; identical to SEQ ID NO: 1328
  Description of Artificial Sequence: Synthetic polypeptide

SEQ ID NO: 1385 - protein, 11 aa, Artificial Sequence
  Description of Artificial Sequence: Synthetic peptide
KGSQNINNYLA

SEQ ID NO: 1386 - protein, 7 aa, Artificial Sequence
  Description of Artificial Sequence: Synthetic peptide
KTNNLQT

SEQ ID NO: 1387 - protein, 8 aa, Artificial Sequence
  Description of Artificial Sequence: Synthetic peptide
YQYDNGYT

SEQ ID NO: 1388 - protein, 123 aa, Artificial Sequence; identical to SEQ ID NO: 1308
  Description of Artificial Sequence: Synthetic polypeptide

SEQ ID NO: 1389 - protein, 10 aa, Artificial Sequence
  Description of Artificial Sequence: Synthetic peptide
GYTFTDYVMH

SEQ ID NO: 1390 - protein, 17 aa, Artificial Sequence
  Description of Artificial Sequence: Synthetic peptide
TIIPLIDTTSYNQKFKG

SEQ ID NO: 1391 - protein, 14 aa, Artificial Sequence
  Description of Artificial Sequence: Synthetic peptide
TSPYYYSSYDVMDA

SEQ ID NO: 1392 - protein, 106 aa, Artificial Sequence; identical to SEQ ID NO: 1304
  Description of Artificial Sequence: Synthetic polypeptide

SEQ ID NO: 1393 - protein, 11 aa, Artificial Sequence
  Description of Artificial Sequence: Synthetic peptide
KGSQNINNYLA

SEQ ID NO: 1394 - protein, 7 aa, Artificial Sequence
  Description of Artificial Sequence: Synthetic peptide
KTNNLQT

SEQ ID NO: 1395 - protein, 8 aa, Artificial Sequence
  Description of Artificial Sequence: Synthetic peptide
YQYDNGYT

SEQ ID NO: 1396 - protein, 123 aa, Artificial Sequence
  Description of Artificial Sequence: Synthetic polypeptide
EVTLRESGPALVKPTQTLTLTCTFSGFSLSTFGMGVGWIRQPPGKALEWLANIWWDDDKYYNPSLKNRLTISKDTSKNQVVLTMTNMDPVDTATYYCARISTGISSYYVMDAWGQGTTVTVSS

SEQ ID NO: 1397 - protein, 12 aa, Artificial Sequence
  Description of Artificial Sequence: Synthetic peptide
GFSLSTFGMGVG

SEQ ID NO: 1398 - protein, 16 aa, Artificial Sequence
  Description of Artificial Sequence: Synthetic peptide
NIWWDDDKYYNPSLKN

SEQ ID NO: 1399 - protein, 13 aa, Artificial Sequence
  Description of Artificial Sequence: Synthetic peptide
ISTGISSYYVMDA

SEQ ID NO: 1400 - protein, 111 aa, Artificial Sequence
  Description of Artificial Sequence: Synthetic polypeptide
NFMLTQPHSVSESPGKTVTISCERSSGDIGDTYVSWYQQRPGSSPTTVIYGNDQRPSGVPDRFSGSIDSSSNSASLTISGLKTEDEADYYCQSYDSDIDIVFGGGTKLTVL

SEQ ID NO: 1401 - protein, 13 aa, Artificial Sequence
  Description of Artificial Sequence: Synthetic peptide
ERSSGDIGDTYVS

SEQ ID NO: 1402 - protein, 7 aa, Artificial Sequence
  Description of Artificial Sequence: Synthetic peptide
GNDQRPS

SEQ ID NO: 1403 - protein, 10 aa, Artificial Sequence
  Description of Artificial Sequence: Synthetic peptide
QSYDSDIDIV

SEQ ID NO: 1404 - protein, 123 aa, Artificial Sequence; identical to SEQ ID NO: 3
  Description of Artificial Sequence: Synthetic polypeptide

SEQ ID NO: 1405 - protein, 12 aa, Artificial Sequence
  Description of Artificial Sequence: Synthetic peptide
GFSLSTFGMGVG

SEQ ID NO: 1406 - protein, 16 aa, Artificial Sequence
  Description of Artificial Sequence: Synthetic peptide
NIWWDDDKYYNPSLKN

SEQ ID NO: 1407 - protein, 13 aa, Artificial Sequence
  Description of Artificial Sequence: Synthetic peptide
ISTGISSYYVMDA

SEQ ID NO: 1408 - protein, 110 aa, Artificial Sequence; identical to SEQ ID NO: 212
  Description of Artificial Sequence: Synthetic polypeptide

SEQ ID NO: 1409 - protein, 13 aa, Artificial Sequence
  Description of Artificial Sequence: Synthetic peptide
ERSSGDIGDTYVS

SEQ ID NO: 1410 - protein, 7 aa, Artificial Sequence
  Description of Artificial Sequence: Synthetic peptide
GNDQRPS

SEQ ID NO: 1411 - protein, 10 aa, Artificial Sequence
  Description of Artificial Sequence: Synthetic peptide
QSYDSDIDIV

SEQ ID NO: 1412 - protein, 123 aa, Artificial Sequence; identical to SEQ ID NO: 211
  Description of Artificial Sequence: Synthetic polypeptide

SEQ ID NO: 1413 - protein, 12 aa, Artificial Sequence
  Description of Artificial Sequence: Synthetic peptide
GFSLSTFGMGVG

SEQ ID NO: 1414 - protein, 16 aa, Artificial Sequence
  Description of Artificial Sequence: Synthetic peptide
NIWWDDDKYYNPSLKN

SEQ ID NO: 1415 - protein, 13 aa, Artificial Sequence
  Description of Artificial Sequence: Synthetic peptide
ISTGISSYYVMDA

SEQ ID NO: 1416 - protein, 110 aa, Artificial Sequence; identical to SEQ ID NO: 4
  Description of Artificial Sequence: Synthetic polypeptide

SEQ ID NO: 1417 - protein, 13 aa, Artificial Sequence
  Description of Artificial Sequence: Synthetic peptide
ERSSGDIGDTYVS

SEQ ID NO: 1418 - protein, 7 aa, Artificial Sequence
  Description of Artificial Sequence: Synthetic peptide
GNDQRPS

SEQ ID NO: 1419 - protein, 10 aa, Artificial Sequence
  Description of Artificial Sequence: Synthetic peptide
QSYDSDIDIV

SEQ ID NO: 1420 - protein, 123 aa, Artificial Sequence; identical to SEQ ID NO: 211
  Description of Artificial Sequence: Synthetic polypeptide

SEQ ID NO: 1421 - protein, 12 aa, Artificial Sequence
  Description of Artificial Sequence: Synthetic peptide
GFSLSTFGMGVG

SEQ ID NO: 1422 - protein, 16 aa, Artificial Sequence
  Description of Artificial Sequence: Synthetic peptide
NIWWDDDKYYNPSLKN

SEQ ID NO: 1423 - protein, 13 aa, Artificial Sequence
  Description of Artificial Sequence: Synthetic peptide
ISTGISSYYVMDA

SEQ ID NO: 1424 - protein, 110 aa, Artificial Sequence; identical to SEQ ID NO: 212
  Description of Artificial Sequence: Synthetic polypeptide

SEQ ID NO: 1425 - protein, 13 aa, Artificial Sequence
  Description of Artificial Sequence: Synthetic peptide
ERSSGDIGDTYVS

SEQ ID NO: 1426 - protein, 7 aa, Artificial Sequence
  Description of Artificial Sequence: Synthetic peptide
GNDQRPS

SEQ ID NO: 1427 - protein, 10 aa, Artificial Sequence
  Description of Artificial Sequence: Synthetic peptide
QSYDSDIDIV

SEQ ID NO: 1428 - protein, 123 aa, Artificial Sequence
  Description of Artificial Sequence: Synthetic polypeptide
EVTLKESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSS

SEQ ID NO: 1429 - protein, 12 aa, Artificial Sequence
  Description of Artificial Sequence: Synthetic peptide
GFSLSTFGMGVG

SEQ ID NO: 1430 - protein, 16 aa, Artificial Sequence
  Description of Artificial Sequence: Synthetic peptide
NIWWDDDKYYNPSLKN

SEQ ID NO: 1431 - protein, 13 aa, Artificial Sequence
  Description of Artificial Sequence: Synthetic peptide
ISTGISSYYVMDA

SEQ ID NO: 1432 - protein, 110 aa, Artificial Sequence; identical to SEQ ID NO: 212
  Description of Artificial Sequence: Synthetic polypeptide

SEQ ID NO: 1433 - protein, 13 aa, Artificial Sequence
  Description of Artificial Sequence: Synthetic peptide
ERSSGDIGDTYVS

SEQ ID NO: 1434 - protein, 7 aa, Artificial Sequence
  Description of Artificial Sequence: Synthetic peptide
GNDQRPS

SEQ ID NO: 1435 - protein, 10 aa, Artificial Sequence
  Description of Artificial Sequence: Synthetic peptide
QSYDSDIDIV

SEQ ID NO: 1436 - protein, 123 aa, Artificial Sequence
  Description of Artificial Sequence: Synthetic polypeptide
EVTLKESGPALVKPTQTLTLTCTFSGFSLSTFGMGVGWIRQPPGKGLEWLANIWWDDDKYYNPSLKNRLTISKDTSNSQAVLTITNMDPVDTATYYCARISTGISSYYVMDAWGQGTTVTVSS

SEQ ID NO: 1437 - protein, 12 aa, Artificial Sequence
  Description of Artificial Sequence: Synthetic peptide
GFSLSTFGMGVG

SEQ ID NO: 1438 - protein, 16 aa, Artificial Sequence
  Description of Artificial Sequence: Synthetic peptide
NIWWDDDKYYNPSLKN

SEQ ID NO: 1439 - protein, 13 aa, Artificial Sequence
  Description of Artificial Sequence: Synthetic peptide
ISTGISSYYVMDA

SEQ ID NO: 1440 - protein, 110 aa, Artificial Sequence
  Description of Artificial Sequence: Synthetic polypeptide
EFVLTQSPGTLSLSPGERATLSCERSSGDIGDTYVSWYQQKPGQPPRNVIYGNDQRPSGVPDRFSGSGSGTDFTLTISRLEPEDFAVYFCQSYDSDIDIVFGGGTKVEIK

SEQ ID NO: 1441 - protein, 13 aa, Artificial Sequence
  Description of Artificial Sequence: Synthetic peptide
ERSSGDIGDTYVS

SEQ ID NO: 1442 - protein, 7 aa, Artificial Sequence
  Description of Artificial Sequence: Synthetic peptide
GNDQRPS

SEQ ID NO: 1443 - protein, 10 aa, Artificial Sequence
  Description of Artificial Sequence: Synthetic peptide
QSYDSDIDIV

SEQ ID NO: 1444 - protein, 123 aa, Artificial Sequence; identical to SEQ ID NO: 1436
  Description of Artificial Sequence: Synthetic polypeptide

SEQ ID NO: 1445 - protein, 12 aa, Artificial Sequence
  Description of Artificial Sequence: Synthetic peptide
GFSLSTFGMGVG

SEQ ID NO: 1446 - protein, 16 aa, Artificial Sequence
  Description of Artificial Sequence: Synthetic peptide
NIWWDDDKYYNPSLKN

SEQ ID NO: 1447 - protein, 13 aa, Artificial Sequence
  Description of Artificial Sequence: Synthetic peptide
ISTGISSYYVMDA

SEQ ID NO: 1448 - protein, 110 aa, Artificial Sequence; identical to SEQ ID NO: 2
  Description of Artificial Sequence: Synthetic polypeptide

SEQ ID NO: 1449 - protein, 13 aa, Artificial Sequence
  Description of Artificial Sequence: Synthetic peptide
ERSSGDIGDSYVS

SEQ ID NO: 1450 - protein, 7 aa, Artificial Sequence
  Description of Artificial Sequence: Synthetic peptide
ADDQRPS

SEQ ID NO: 1451 - protein, 10 aa, Artificial Sequence
  Description of Artificial Sequence: Synthetic peptide
QSYDINIDIV

SEQ ID NO: 1452 - protein, 123 aa, Artificial Sequence; identical to SEQ ID NO: 1396
  Description of Artificial Sequence: Synthetic polypeptide

SEQ ID NO: 1453 - protein, 12 aa, Artificial Sequence
  Description of Artificial Sequence: Synthetic peptide
GFSLSTFGMGVG

SEQ ID NO: 1454 - protein, 16 aa, Artificial Sequence
  Description of Artificial Sequence: Synthetic peptide
NIWWDDDKYYNPSLKN

SEQ ID NO: 1455 - protein, 13 aa, Artificial Sequence
  Description of Artificial Sequence: Synthetic peptide
ISTGISSYYVMDA

SEQ ID NO: 1456 - protein, 111 aa, Artificial Sequence
  Description of Artificial Sequence: Synthetic polypeptide
NFMLTQPHSVSESPGKTVTISCERSSGDIGDTYVSWYQQRPGSPPTNVIYGNDQRPSGVPDRFSGSIDSSSNSASLTISGLKTEDEADYFCQSYDSDIDIVFGGGTKLTVL

SEQ ID NO: 1457 - protein, 13 aa, Artificial Sequence
  Description of Artificial Sequence: Synthetic peptide
ERSSGDIGDTYVS

SEQ ID NO: 1458 - protein, 7 aa, Artificial Sequence
  Description of Artificial Sequence: Synthetic peptide
GNDQRPS

SEQ ID NO: 1459 - protein, 10 aa, Artificial Sequence
  Description of Artificial Sequence: Synthetic peptide
QSYDSDIDIV

SEQ ID NO: 1460 - protein, 123 aa, Artificial Sequence; identical to SEQ ID NO: 1396
  Description of Artificial Sequence: Synthetic polypeptide

SEQ ID NO: 1461 - protein, 12 aa, Artificial Sequence
  Description of Artificial Sequence: Synthetic peptide
GFSLSTFGMGVG

SEQ ID NO: 1462 - protein, 16 aa, Artificial Sequence
  Description of Artificial Sequence: Synthetic peptide
NIWWDDDKYYNPSLKN

SEQ ID NO: 1463 - protein, 13 aa, Artificial Sequence
  Description of Artificial Sequence: Synthetic peptide
ISTGISSYYVMDA

SEQ ID NO: 1464 - protein, 110 aa, Artificial Sequence
  Description of Artificial Sequence: Synthetic polypeptide
EIVLTQSPGTLSLSPGERATLSCERSSGDIGDTYVSWYQQKPGQAPRLLIYGNDQRPSGIPDRFSGSGSGTDFTLTISRLEPEDFAVYYCQSYDSDIDIVFGGGTKVEIK

SEQ ID NO: 1465 - protein, 13 aa, Artificial Sequence
  Description of Artificial Sequence: Synthetic peptide
ERSSGDIGDTYVS

SEQ ID NO: 1466 - protein, 7 aa, Artificial Sequence
  Description of Artificial Sequence: Synthetic peptide
GNDQRPS

SEQ ID NO: 1467 - protein, 10 aa, Artificial Sequence
  Description of Artificial Sequence: Synthetic peptide
QSYDSDIDIV

SEQ ID NO: 1468 - protein, 123 aa, Artificial Sequence; identical to SEQ ID NO: 1396
  Description of Artificial Sequence: Synthetic polypeptide

SEQ ID NO: 1469 - protein, 12 aa, Artificial Sequence
  Description of Artificial Sequence: Synthetic peptide
GFSLSTFGMGVG

SEQ ID NO: 1470 - protein, 16 aa, Artificial Sequence
  Description of Artificial Sequence: Synthetic peptide
NIWWDDDKYYNPSLKN

SEQ ID NO: 1471 - protein, 13 aa, Artificial Sequence
  Description of Artificial Sequence: Synthetic peptide
ISTGISSYYVMDA

SEQ ID NO: 1472 - protein, 110 aa, Artificial Sequence
  Description of Artificial Sequence: Synthetic polypeptide
EFVLTQSPGTLSLSPGERATLSCERSSGDIGDTYVSWYQQKPGQAPRLVIYGNDQRPSGIPDRFSGSGSGTDFTLTISRLEPEDFAVYYCQSYDSDIDIVFGGGTKVEIK

SEQ ID NO: 1473 - protein, 13 aa, Artificial Sequence
  Description of Artificial Sequence: Synthetic peptide
ERSSGDIGDTYVS

SEQ ID NO: 1474 - protein, 7 aa, Artificial Sequence
  Description of Artificial Sequence: Synthetic peptide
GNDQRPS

SEQ ID NO: 1475 - protein, 10 aa, Artificial Sequence
  Description of Artificial Sequence: Synthetic peptide
QSYDSDIDIV

SEQ ID NO: 1476 - protein, 123 aa, Artificial Sequence; identical to SEQ ID NO: 1428
  Description of Artificial Sequence: Synthetic polypeptide

SEQ ID NO: 1477 - protein, 12 aa, Artificial Sequence
  Description of Artificial Sequence: Synthetic peptide
GFSLSTFGMGVG

SEQ ID NO: 1478 - protein, 16 aa, Artificial Sequence
  Description of Artificial Sequence: Synthetic peptide
NIWWDDDKYYNPSLKN

SEQ ID NO: 1479 - protein, 13 aa, Artificial Sequence
  Description of Artificial Sequence: Synthetic peptide
ISTGISSYYVMDA

SEQ ID NO: 1480 - protein, 111 aa, Artificial Sequence; identical to SEQ ID NO: 1400
  Description of Artificial Sequence: Synthetic polypeptide

SEQ ID NO: 1481 - protein, 13 aa, Artificial Sequence
  Description of Artificial Sequence: Synthetic peptide
ERSSGDIGDTYVS

SEQ ID NO: 1482 - protein, 7 aa, Artificial Sequence
  Description of Artificial Sequence: Synthetic peptide
GNDQRPS

SEQ ID NO: 1483 - protein, 10 aa, Artificial Sequence
  Description of Artificial Sequence: Synthetic peptide
QSYDSDIDIV

SEQ ID NO: 1484 - protein, 123 aa, Artificial Sequence; identical to SEQ ID NO: 1428
  Description of Artificial Sequence: Synthetic polypeptide

SEQ ID NO: 1485 - protein, 12 aa, Artificial Sequence
  Description of Artificial Sequence: Synthetic peptide
GFSLSTFGMGVG

SEQ ID NO: 1486 - protein, 16 aa, Artificial Sequence
  Description of Artificial Sequence: Synthetic peptide
NIWWDDDKYYNPSLKN

SEQ ID NO: 1487 - protein, 13 aa, Artificial Sequence
  Description of Artificial Sequence: Synthetic peptide
ISTGISSYYVMDA

SEQ ID NO: 1488 - protein, 111 aa, Artificial Sequence; identical to SEQ ID NO: 1456
  Description of Artificial Sequence: Synthetic polypeptide

SEQ ID NO: 1489 - protein, 13 aa, Artificial Sequence
  Description of Artificial Sequence: Synthetic peptide
ERSSGDIGDTYVS

SEQ ID NO: 1490 - protein, 7 aa, Artificial Sequence
  Description of Artificial Sequence: Synthetic peptide
GNDQRPS

SEQ ID NO: 1491 - protein, 10 aa, Artificial Sequence
  Description of Artificial Sequence: Synthetic peptide
QSYDSDIDIV

SEQ ID NO: 1492 - protein, 123 aa, Artificial Sequence; identical to SEQ ID NO: 1428
  Description of Artificial Sequence: Synthetic polypeptide

SEQ ID NO: 1493 - protein, 12 aa, Artificial Sequence
  Description of Artificial Sequence: Synthetic peptide
GFSLSTFGMGVG

SEQ ID NO: 1494 - protein, 16 aa, Artificial Sequence
  Description of Artificial Sequence: Synthetic peptide
NIWWDDDKYYNPSLKN

SEQ ID NO: 1495 - protein, 13 aa, Artificial Sequence
  Description of Artificial Sequence: Synthetic peptide
ISTGISSYYVMDA

SEQ ID NO: 1496 - protein, 110 aa, Artificial Sequence; identical to SEQ ID NO: 1464
  Description of Artificial Sequence: Synthetic polypeptide

SEQ ID NO: 1497 - protein, 13 aa, Artificial Sequence
  Description of Artificial Sequence: Synthetic peptide
ERSSGDIGDTYVS

SEQ ID NO: 1498 - protein, 7 aa, Artificial Sequence
  Description of Artificial Sequence: Synthetic peptide
GNDQRPS

SEQ ID NO: 1499 - protein, 10 aa, Artificial Sequence
  Description of Artificial Sequence: Synthetic peptide
QSYDSDIDIV

SEQ ID NO: 1500 - protein, 123 aa, Artificial Sequence; identical to SEQ ID NO: 1428
  Description of Artificial Sequence: Synthetic polypeptide

SEQ ID NO: 1501 - protein, 12 aa, Artificial Sequence
  Description of Artificial Sequence: Synthetic peptide
GFSLSTFGMGVG

SEQ ID NO: 1502 - protein, 16 aa, Artificial Sequence
  Description of Artificial Sequence: Synthetic peptide
NIWWDDDKYYNPSLKN

SEQ ID NO: 1503 - protein, 13 aa, Artificial Sequence
  Description of Artificial Sequence: Synthetic peptide
ISTGISSYYVMDA

SEQ ID NO: 1504 - protein, 110 aa, Artificial Sequence; identical to SEQ ID NO: 1472
  Description of Artificial Sequence: Synthetic polypeptide

SEQ ID NO: 1505 - protein, 13 aa, Artificial Sequence
  Description of Artificial Sequence: Synthetic peptide
ERSSGDIGDTYVS

SEQ ID NO: 1506 - protein, 7 aa, Artificial Sequence
  Description of Artificial Sequence: Synthetic peptide
GNDQRPS

SEQ ID NO: 1507 - protein, 10 aa, Artificial Sequence
  Description of Artificial Sequence: Synthetic peptide
QSYDSDIDIV

SEQ ID NO: 1508 - protein, 123 aa, Artificial Sequence; identical to SEQ ID NO: 3
  Description of Artificial Sequence: Synthetic polypeptide

SEQ ID NO: 1509 - protein, 12 aa, Artificial Sequence
  Description of Artificial Sequence: Synthetic peptide
GFSLSTFGMGVG

SEQ ID NO: 1510 - protein, 16 aa, Artificial Sequence
  Description of Artificial Sequence: Synthetic peptide
NIWWDDDKYYNPSLKN

SEQ ID NO: 1511 - protein, 13 aa, Artificial Sequence
  Description of Artificial Sequence: Synthetic peptide
ISTGISSYYVMDA

SEQ ID NO: 1512 - protein, 110 aa, Artificial Sequence; identical to SEQ ID NO: 4
  Description of Artificial Sequence: Synthetic polypeptide

SEQ ID NO: 1513 - protein, 13 aa, Artificial Sequence
  Description of Artificial Sequence: Synthetic peptide
ERSSGDIGDTYVS

SEQ ID NO: 1514 - protein, 7 aa, Artificial Sequence
  Description of Artificial Sequence: Synthetic peptide
GNDQRPS

SEQ ID NO: 1515 - protein, 10 aa, Artificial Sequence
  Description of Artificial Sequence: Synthetic peptide
QSYDSDIDIV

SEQ ID NO: 1516 - protein, 122 aa, Artificial Sequence; identical to SEQ ID NO: 1
  Description of Artificial Sequence: Synthetic polypeptide

SEQ ID NO: 1517 - protein, 12 aa, Artificial Sequence
  Description of Artificial Sequence: Synthetic peptide
GFSLSTYGMGVG

SEQ ID NO: 1518 - protein, 16 aa, Artificial Sequence
  Description of Artificial Sequence: Synthetic peptide
NIWWDDDKYYNPSLKN

SEQ ID NO: 1519 - protein, 12 aa, Artificial Sequence
  Description of Artificial Sequence: Synthetic peptide
IESIGTTYSFDY

SEQ ID NO: 1520 - protein, 111 aa, Artificial Sequence
  Description of Artificial Sequence: Synthetic polypeptide
NFMLTQPHSVSESPGKTVTISCERSSGDIGDSYVSWYQQRPGSSPTTVIYADDQRPSGVPDRFSGSIDSSSNSASLTISGLKTEDEADYYCQSYDINIDIVFGGGTKLTVL

SEQ ID NO: 1521 - protein, 13 aa, Artificial Sequence
  Description of Artificial Sequence: Synthetic peptide
ERSSGDIGDSYVS

SEQ ID NO: 1522 - protein, 7 aa, Artificial Sequence
  Description of Artificial Sequence: Synthetic peptide
ADDQRPS

SEQ ID NO: 1523 - protein, 10 aa, Artificial Sequence
  Description of Artificial Sequence: Synthetic peptide
QSYDINIDIV

SEQ ID NO: 1524 - protein, 122 aa, Artificial Sequence; identical to SEQ ID NO: 7
  Description of Artificial Sequence: Synthetic polypeptide

SEQ ID NO: 1525 - protein, 12 aa, Artificial Sequence
  Description of Artificial Sequence: Synthetic peptide
GFSLSTYGMGVG

SEQ ID NO: 1526 - protein, 16 aa, Artificial Sequence
  Description of Artificial Sequence: Synthetic peptide
NIWWDDDKYYNPSLKN

SEQ ID NO: 1527 - protein, 12 aa, Artificial Sequence
  Description of Artificial Sequence: Synthetic peptide
IESIGTTYSFDY

SEQ ID NO: 1528 - protein, 110 aa, Artificial Sequence; identical to SEQ ID NO: 6
  Description of Artificial Sequence: Synthetic polypeptide

SEQ ID NO: 1529 - protein, 13 aa, Artificial Sequence
  Description of Artificial Sequence: Synthetic peptide
ERSSGDIGDSYVS

SEQ ID NO: 1530 - protein, 7 aa, Artificial Sequence
  Description of Artificial Sequence: Synthetic peptide
ADDQRPS

SEQ ID NO: 1531 - protein, 10 aa, Artificial Sequence
  Description of Artificial Sequence: Synthetic peptide
QSYDINIDIV

SEQ ID NO: 1532 - protein, 122 aa, Artificial Sequence; identical to SEQ ID NO: 5
  Description of Artificial Sequence: Synthetic polypeptide

SEQ ID NO: 1533 - protein, 12 aa, Artificial Sequence
  Description of Artificial Sequence: Synthetic peptide
GFSLSTYGMGVG

SEQ ID NO: 1534 - protein, 16 aa, Artificial Sequence
  Description of Artificial Sequence: Synthetic peptide
NIWWDDDKYYNPSLKN

SEQ ID NO: 1535 - protein, 12 aa, Artificial Sequence
  Description of Artificial Sequence: Synthetic peptide
IESIGTTYSFDY

SEQ ID NO: 1536 - protein, 110 aa, Artificial Sequence; identical to SEQ ID NO: 8
  Description of Artificial Sequence: Synthetic polypeptide

SEQ ID NO: 1537 - protein, 13 aa, Artificial Sequence
  Description of Artificial Sequence: Synthetic peptide
ERSSGDIGDSYVS

SEQ ID NO: 1538 - protein, 7 aa, Artificial Sequence
  Description of Artificial Sequence: Synthetic peptide
ADDQRPS

SEQ ID NO: 1539 - protein, 10 aa, Artificial Sequence
  Description of Artificial Sequence: Synthetic peptide
QSYDINIDIV

SEQ ID NO: 1540 - protein, 122 aa, Artificial Sequence; identical to SEQ ID NO: 5
  Description of Artificial Sequence: Synthetic polypeptide

SEQ ID NO: 1541 - protein, 12 aa, Artificial Sequence
  Description of Artificial Sequence: Synthetic peptide
GFSLSTYGMGVG

SEQ ID NO: 1542 - protein, 16 aa, Artificial Sequence
  Description of Artificial Sequence: Synthetic peptide
NIWWDDDKYYNPSLKN

SEQ ID NO: 1543 - protein, 12 aa, Artificial Sequence
  Description of Artificial Sequence: Synthetic peptide
IESIGTTYSFDY

SEQ ID NO: 1544 - protein, 110 aa, Artificial Sequence; identical to SEQ ID NO: 6
  Description of Artificial Sequence: Synthetic polypeptide

SEQ ID NO: 1545 - protein, 13 aa, Artificial Sequence
  Description of Artificial Sequence: Synthetic peptide
ERSSGDIGDSYVS

SEQ ID NO: 1546 - protein, 7 aa, Artificial Sequence
  Description of Artificial Sequence: Synthetic peptide
ADDQRPS

SEQ ID NO: 1547 - protein, 10 aa, Artificial Sequence
  Description of Artificial Sequence: Synthetic peptide
QSYDINIDIV

SEQ ID NO: 1548 - protein, 122 aa, Artificial Sequence
  Description of Artificial Sequence: Synthetic polypeptide
EVTLRESGPALVKPTQTLTLTCTFSGFSLSTYGMGVGWIRQPPGKGLEWLANIWWDDDKYYNPSLKNRLTISKDTSKNQAVLTITNMDPVDTATYYCARIESIGTTYSFDYWGQGTMVTVSS

SEQ ID NO: 1549 - protein, 12 aa, Artificial Sequence
  Description of Artificial Sequence: Synthetic peptide
GFSLSTYGMGVG

SEQ ID NO: 1550 - protein, 16 aa, Artificial Sequence
  Description of Artificial Sequence: Synthetic peptide
NIWWDDDKYYNPSLKN

SEQ ID NO: 1551 - protein, 12 aa, Artificial Sequence
  Description of Artificial Sequence: Synthetic peptide
IESIGTTYSFDY

SEQ ID NO: 1552 - protein, 110 aa, Artificial Sequence; identical to SEQ ID NO: 6
  Description of Artificial Sequence: Synthetic polypeptide

SEQ ID NO: 1553 - protein, 13 aa, Artificial Sequence
  Description of Artificial Sequence: Synthetic peptide
ERSSGDIGDSYVS

SEQ ID NO: 1554 - protein, 7 aa, Artificial Sequence
  Description of Artificial Sequence: Synthetic peptide
ADDQRPS

SEQ ID NO: 1555 - protein, 10 aa, Artificial Sequence
  Description of Artificial Sequence: Synthetic peptide
QSYDINIDIV

SEQ ID NO: 1556 - protein, 122 aa, Artificial Sequence; identical to SEQ ID NO: 1
  Description of Artificial Sequence: Synthetic polypeptide

SEQ ID NO: 1557 - protein, 12 aa, Artificial Sequence
  Description of Artificial Sequence: Synthetic peptide
GFSLSTYGMGVG

SEQ ID NO: 1558 - protein, 16 aa, Artificial Sequence
  Description of Artificial Sequence: Synthetic peptide
NIWWDDDKYYNPSLKN

SEQ ID NO: 1559 - protein, 12 aa, Artificial Sequence
  Description of Artificial Sequence: Synthetic peptide
IESIGTTYSFDY

SEQ ID NO: 1560 - protein, 111 aa, Artificial Sequence
  Description of Artificial Sequence: Synthetic polypeptide
NFMLTQPHSVSESPGKTVTISCERSSGDIGDSYVSWYQQRPGSPPTNVIYADDQRPSGVPDRFSGSIDSSSNSASLTISGLKTEDEADYFCQSYDINIDIVFGGGTKLTVL

SEQ ID NO: 1561 - protein, 13 aa, Artificial Sequence
  Description of Artificial Sequence: Synthetic peptide
ERSSGDIGDSYVS

SEQ ID NO: 1562 - protein, 7 aa, Artificial Sequence
  Description of Artificial Sequence: Synthetic peptide
ADDQRPS

SEQ ID NO: 1563 - protein, 10 aa, Artificial Sequence
  Description of Artificial Sequence: Synthetic peptide
QSYDINIDIV

SEQ ID NO: 1564 - protein, 122 aa, Artificial Sequence; identical to SEQ ID NO: 1
  Description of Artificial Sequence: Synthetic polypeptide

SEQ ID NO: 1565 - protein, 12 aa, Artificial Sequence
  Description of Artificial Sequence: Synthetic peptide
GFSLSTYGMGVG

SEQ ID NO: 1566 - protein, 16 aa, Artificial Sequence
  Description of Artificial Sequence: Synthetic peptide
NIWWDDDKYYNPSLKN

SEQ ID NO: 1567 - protein, 12 aa, Artificial Sequence
  Description of Artificial Sequence: Synthetic peptide
IESIGTTYSFDY

SEQ ID NO: 1568 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYADDQRPSGIPDRFSGSGSGTDFTLTISRLEPEDFAVYYCQSYDINIDIVFGGGTKVEIK

SEQ ID NO: 1569 - protein, 13 aa, Artificial Sequence
  Description of Artificial Sequence: Synthetic peptide
ERSSGDIGDSYVS

SEQ ID NO: 1570 - protein, 7 aa, Artificial Sequence
  Description of Artificial Sequence: Synthetic peptide
ADDQRPS

SEQ ID NO: 1571 - protein, 10 aa, Artificial Sequence
  Description of Artificial Sequence: Synthetic peptide
QSYDINIDIV

SEQ ID NO: 1572 - protein, 122 aa, Artificial Sequence; identical to SEQ ID NO: 1
  Description of Artificial Sequence: Synthetic polypeptide

SEQ ID NO: 1573 - protein, 12 aa, Artificial Sequence
  Description of Artificial Sequence: Synthetic peptide
GFSLSTYGMGVG

SEQ ID NO: 1574 - protein, 16 aa, Artificial Sequence
  Description of Artificial Sequence: Synthetic peptide
NIWWDDDKYYNPSLKN

SEQ ID NO: 1575 - protein, 12 aa, Artificial Sequence
  Description of Artificial Sequence: Synthetic peptide
IESIGTTYSFDY

SEQ ID NO: 1576 - protein, 110 aa, Artificial Sequence; identical to SEQ ID NO: 2
  Description of Artificial Sequence: Synthetic polypeptide

SEQ ID NO: 1577 - protein, 13 aa, Artificial Sequence
  Description of Artificial Sequence: Synthetic peptide
ERSSGDIGDSYVS

SEQ ID NO: 1578 - protein, 7 aa, Artificial Sequence
  Description of Artificial Sequence: Synthetic peptide
ADDQRPS

SEQ ID NO: 1579 - protein, 10 aa, Artificial Sequence
  Description of Artificial Sequence: Synthetic peptide
QSYDINIDIV

SEQ ID NO: 1580 - protein, 122 aa, Artificial Sequence; identical to SEQ ID NO: 1548
  Description of Artificial Sequence: Synthetic polypeptide

SEQ ID NO: 1581 - protein, 12 aa, Artificial Sequence
  Description of Artificial Sequence: Synthetic peptide
GFSLSTYGMGVG

SEQ ID NO: 1582 - protein, 16 aa, Artificial Sequence
  Description of Artificial Sequence: Synthetic peptide
NIWWDDDKYYNPSLKN

SEQ ID NO: 1583 - protein, 12 aa, Artificial Sequence
  Description of Artificial Sequence: Synthetic peptide
IESIGTTYSFDY

SEQ ID NO: 1584 - protein, 111 aa, Artificial Sequence; identical to SEQ ID NO: 1520
  Description of Artificial Sequence: Synthetic polypeptide

SEQ ID NO: 1585 - protein, 13 aa, Artificial Sequence
  Description of Artificial Sequence: Synthetic peptide
ERSSGDIGDSYVS

SEQ ID NO: 1586 - protein, 7 aa, Artificial Sequence
  Description of Artificial Sequence: Synthetic peptide
ADDQRPS

SEQ ID NO: 1587 - protein, 10 aa, Artificial Sequence
  Description of Artificial Sequence: Synthetic peptide
QSYDINIDIV

SEQ ID NO: 1588 - protein, 122 aa, Artificial Sequence; identical to SEQ ID NO: 1548
  Description of Artificial Sequence: Synthetic polypeptide

SEQ ID NO: 1589 - protein, 12 aa, Artificial Sequence
  Description of Artificial Sequence: Synthetic peptide
GFSLSTYGMGVG

SEQ ID NO: 1590 - protein, 16 aa, Artificial Sequence
  Description of Artificial Sequence: Synthetic peptide
NIWWDDDKYYNPSLKN

SEQ ID NO: 1591 - protein, 12 aa, Artificial Sequence
  Description of Artificial Sequence: Synthetic peptide
IESIGTTYSFDY

SEQ ID NO: 1592 - protein, 111 aa, Artificial Sequence; identical to SEQ ID NO: 1560
  Description of Artificial Sequence: Synthetic polypeptide

SEQ ID NO: 1593 - protein, 13 aa, Artificial Sequence
  Description of Artificial Sequence: Synthetic peptide
ERSSGDIGDSYVS

SEQ ID NO: 1594 - protein, 7 aa, Artificial Sequence
  Description of Artificial Sequence: Synthetic peptide
ADDQRPS

SEQ ID NO: 1595 - protein, 10 aa, Artificial Sequence
  Description of Artificial Sequence: Synthetic peptide
QSYDINIDIV

SEQ ID NO: 1596 - protein, 122 aa, Artificial Sequence; identical to SEQ ID NO: 1548
  Description of Artificial Sequence: Synthetic polypeptide

SEQ ID NO: 1597 - protein, 12 aa, Artificial Sequence
  Description of Artificial Sequence: Synthetic peptide
GFSLSTYGMGVG

SEQ ID NO: 1598 - protein, 16 aa, Artificial Sequence
  Description of Artificial Sequence: Synthetic peptide
NIWWDDDKYYNPSLKN

SEQ ID NO: 1599 - protein, 12 aa, Artificial Sequence
  Description of Artificial Sequence: Synthetic peptide
IESIGTTYSFDY

SEQ ID NO: 1600 - protein, 110 aa, Artificial Sequence; identical to SEQ ID NO: 1568
  Description of Artificial Sequence: Synthetic polypeptide

SEQ ID NO: 1601 - protein, 13 aa, Artificial Sequence
  Description of Artificial Sequence: Synthetic peptide
ERSSGDIGDSYVS

SEQ ID NO: 1602 - protein, 7 aa, Artificial Sequence
  Description of Artificial Sequence: Synthetic peptide
ADDQRPS

SEQ ID NO: 1603 - protein, 10 aa, Artificial Sequence
  Description of Artificial Sequence: Synthetic peptide
QSYDINIDIV

SEQ ID NO: 1604 - protein, 122 aa, Artificial Sequence; identical to SEQ ID NO: 1548
  Description of Artificial Sequence: Synthetic polypeptide

SEQ ID NO: 1605 - protein, 12 aa, Artificial Sequence
  Description of Artificial Sequence: Synthetic peptide
GFSLSTYGMGVG

SEQ ID NO: 1606 - protein, 16 aa, Artificial Sequence
  Description of Artificial Sequence: Synthetic peptide
NIWWDDDKYYNPSLKN

SEQ ID NO: 1607 - protein, 12 aa, Artificial Sequence
  Description of Artificial Sequence: Synthetic peptide
IESIGTTYSFDY

SEQ ID NO: 1608 - protein, 110 aa, Artificial Sequence; identical to SEQ ID NO: 2
  Description of Artificial Sequence: Synthetic polypeptide

SEQ ID NO: 1609 - protein, 13 aa, Artificial Sequence
  Description of Artificial Sequence: Synthetic peptide
ERSSGDIGDSYVS

SEQ ID NO: 1610 - protein, 7 aa, Artificial Sequence
  Description of Artificial Sequence: Synthetic peptide
ADDQRPS

SEQ ID NO: 1611 - protein, 10 aa, Artificial Sequence
  Description of Artificial Sequence: Synthetic peptide
QSYDINIDIV

SEQ ID NO: 1612 - protein, 122 aa, Artificial Sequence; identical to SEQ ID NO: 7
  Description of Artificial Sequence: Synthetic polypeptide

SEQ ID NO: 1613 - protein, 12 aa, Artificial Sequence
  Description of Artificial Sequence: Synthetic peptide
GFSLSTYGMGVG

SEQ ID NO: 1614 - protein, 16 aa, Artificial Sequence
  Description of Artificial Sequence: Synthetic peptide
NIWWDDDKYYNPSLKN

SEQ ID NO: 1615 - protein, 12 aa, Artificial Sequence
  Description of Artificial Sequence: Synthetic peptide
IESIGTTYSFDY

SEQ ID NO: 1616 - protein, 110 aa, Artificial Sequence; identical to SEQ ID NO: 8
  Description of Artificial Sequence: Synthetic polypeptide

SEQ ID NO: 1617 - protein, 13 aa, Artificial Sequence
  Description of Artificial Sequence: Synthetic peptide
ERSSGDIGDSYVS

SEQ ID NO: 1618 - protein, 7 aa, Artificial Sequence
  Description of Artificial Sequence: Synthetic peptide
ADDQRPS

SEQ ID NO: 1619 - protein, 10 aa, Artificial Sequence
  Description of Artificial Sequence: Synthetic peptide
QSYDINIDIV

SEQ ID NO: 1620 - protein, 122 aa, Artificial Sequence; identical to SEQ ID NO: 1
  Description of Artificial Sequence: Synthetic polypeptide

SEQ ID NO: 1621 - protein, 12 aa, Artificial Sequence
  Description of Artificial Sequence: Synthetic peptide
GFSLSTYGMGVG

SEQ ID NO: 1622 - protein, 16 aa, Artificial Sequence
  Description of Artificial Sequence: Synthetic peptide
NIWWDDDKYYNPSLKN

SEQ ID NO: 1623 - protein, 12 aa, Artificial Sequence
  Description of Artificial Sequence: Synthetic peptide
IESIGTTYSFDY

SEQ ID NO: 1624 - protein, 110 aa, Artificial Sequence; identical to SEQ ID NO: 12
  Description of Artificial Sequence: Synthetic polypeptide

SEQ ID NO: 1625 - protein, 13 aa, Artificial Sequence
  Description of Artificial Sequence: Synthetic peptide
ERSSGDIGESYVS

SEQ ID NO: 1626 - protein, 7 aa, Artificial Sequence
  Description of Artificial Sequence: Synthetic peptide
ADDQRPS

SEQ ID NO: 1627 - protein, 10 aa, Artificial Sequence
  Description of Artificial Sequence: Synthetic peptide
QSYDINIDIV

SEQ ID NO: 1628 - protein, 121 aa, Artificial Sequence; identical to SEQ ID NO: 13
  Description of Artificial Sequence: Synthetic polypeptide

SEQ ID NO: 1629 - protein, 10 aa, Artificial Sequence
  Description of Artificial Sequence: Synthetic peptide
GYTFTESYMY

SEQ ID NO: 1630 - protein, 17 aa, Artificial Sequence
  Description of Artificial Sequence: Synthetic peptide
RIDPEDGSTDYVEKFKN

SEQ ID NO: 1631 - protein, 12 aa, Artificial Sequence
  Description of Artificial Sequence: Synthetic peptide
FGARSYFYPMDA

SEQ ID NO: 1632 - protein, 107 aa, Artificial Sequence; identical to SEQ ID NO: 14
  Description of Artificial Sequence: Synthetic polypeptide

SEQ ID NO: 1633 - protein, 11 aa, Artificial Sequence
  Description of Artificial Sequence: Synthetic peptide
RASESVSTLMH

SEQ ID NO: 1634 - protein, 7 aa, Artificial Sequence
  Description of Artificial Sequence: Synthetic peptide
GASNLES

SEQ ID NO: 1635 - protein, 9 aa, Artificial Sequence
  Description of Artificial Sequence: Synthetic peptide
QQSWNDPWT

SEQ ID NO: 1636 - protein, 121 aa, Artificial Sequence
  Description of Artificial Sequence: Synthetic polypeptide
EVQLVQSGAEVKKPGSSVKVSCKASGYTFTESYMYWVRQAPGQGLELIGRIDPEDGSTDYVEKFKNRVTLTADKSTSTAYMELSSLRSEDTAVYYCARFGARSYFYPMDAWGQGTTVTVSS

SEQ ID NO: 1637 - protein, 10 aa, Artificial Sequence
  Description of Artificial Sequence: Synthetic peptide
GYTFTESYMY

SEQ ID NO: 1638 - protein, 17 aa, Artificial Sequence
  Description of Artificial Sequence: Synthetic peptide
RIDPEDGSTDYVEKFKN

SEQ ID NO: 1639 - protein, 12 aa, Artificial Sequence
  Description of Artificial Sequence: Synthetic peptide
FGARSYFYPMDA

SEQ ID NO: 1640 - protein, 107 aa, Artificial Sequence; identical to SEQ ID NO: 14
  Description of Artificial Sequence: Synthetic polypeptide

SEQ ID NO: 1641 - protein, 11 aa, Artificial Sequence
  Description of Artificial Sequence: Synthetic peptide
RASESVSTLMH

SEQ ID NO: 1642 - protein, 7 aa, Artificial Sequence
  Description of Artificial Sequence: Synthetic peptide
GASNLES

SEQ ID NO: 1643 - protein, 9 aa, Artificial Sequence
  Description of Artificial Sequence: Synthetic peptide
QQSWNDPWT

SEQ ID NO: 1644 - protein, 121 aa, Artificial Sequence; identical to SEQ ID NO: 13
  Description of Artificial Sequence: Synthetic polypeptide

SEQ ID NO: 1645 - protein, 10 aa, Artificial Sequence
  Description of Artificial Sequence: Synthetic peptide
GYTFTESYMY

SEQ ID NO: 1646 - protein, 17 aa, Artificial Sequence
  Description of Artificial Sequence: Synthetic peptide
RIDPEDGSTDYVEKFKN

SEQ ID NO: 1647 - protein, 12 aa, Artificial Sequence
  Description of Artificial Sequence: Synthetic peptide
FGARSYFYPMDA

SEQ ID NO: 1648 - protein, 107 aa, Artificial Sequence
  Description of Artificial Sequence: Synthetic polypeptide
ATQLTQSPSSLSASVGDRVTISCRASESVSTLMHWYQQKPGKQPRLLIYGASNLESGVPSRFSGSGSGTDFTLTISSLQPEDFATYFCQQSWNDPWTFGGGTKVEIK

SEQ ID NO: 1649 - protein, 11 aa, Artificial Sequence
  Description of Artificial Sequence: Synthetic peptide
RASESVSTLMH

SEQ ID NO: 1650 - protein, 7 aa, Artificial Sequence
  Description of Artificial Sequence: Synthetic peptide
GASNLES

SEQ ID NO: 1651 - protein, 9 aa, Artificial Sequence
  Description of Artificial Sequence: Synthetic peptide
QQSWNDPWT

SEQ ID NO: 1652 - protein, 121 aa, Artificial Sequence; identical to SEQ ID NO: 1636
  Description of Artificial Sequence: Synthetic polypeptide

SEQ ID NO: 1653 - protein, 10 aa, Artificial Sequence
  Description of Artificial Sequence: Synthetic peptide
GYTFTESYMY

SEQ ID NO: 1654 - protein, 17 aa, Artificial Sequence
  Description of Artificial Sequence: Synthetic peptide
RIDPEDGSTDYVEKFKN

SEQ ID NO: 1655 - protein, 12 aa, Artificial Sequence
  Description of Artificial Sequence: Synthetic peptide
FGARSYFYPMDA

SEQ ID NO: 1656 - protein, 107 aa, Artificial Sequence; identical to SEQ ID NO: 1648
  Description of Artificial Sequence: Synthetic polypeptide

SEQ ID NO: 1657 - protein, 11 aa, Artificial Sequence
  Description of Artificial Sequence: Synthetic peptide
RASESVSTLMH

SEQ ID NO: 1658 - protein, 7 aa, Artificial Sequence
  Description of Artificial Sequence: Synthetic peptide
GASNLES

SEQ ID NO: 1659 - protein, 9 aa, Artificial Sequence
  Description of Artificial Sequence: Synthetic peptide
QQSWNDPWT

SEQ ID NO: 1660 - protein, 120 aa, Artificial Sequence; identical to SEQ ID NO: 790
  Description of Artificial Sequence: Synthetic polypeptide

SEQ ID NO: 1661 - protein, 10 aa, Artificial Sequence
  Description of Artificial Sequence: Synthetic peptide
GYTFTNYGMY

SEQ ID NO: 1662 - protein, 17 aa, Artificial Sequence
  Description of Artificial Sequence: Synthetic peptide
WINTETGQPTYADDFKG

SEQ ID NO: 1663 - protein, 11 aa, Artificial Sequence
  Description of Artificial Sequence: Synthetic peptide
LGNNYGIWFAY

SEQ ID NO: 1664 - protein, 107 aa, Artificial Sequence; identical to SEQ ID NO: 797
  Description of Artificial Sequence: Synthetic polypeptide

SEQ ID NO: 1665 - protein, 11 aa, Artificial Sequence
  Description of Artificial Sequence: Synthetic peptide
RASDDLYSTLA

SEQ ID NO: 1666 - protein, 7 aa, Artificial Sequence
  Description of Artificial Sequence: Synthetic peptide
DANRLAA

SEQ ID NO: 1667 - protein, 9 aa, Artificial Sequence
  Description of Artificial Sequence: Synthetic peptide
QQYNKFPWT

SEQ ID NO: 1668 - protein, 120 aa, Artificial Sequence; identical to SEQ ID NO: 794
  Description of Artificial Sequence: Synthetic polypeptide

SEQ ID NO: 1669 - protein, 10 aa, Artificial Sequence
  Description of Artificial Sequence: Synthetic peptide
GYTFTNYGMY

SEQ ID NO: 1670 - protein, 17 aa, Artificial Sequence
  Description of Artificial Sequence: Synthetic peptide
WINTETGQPTYADDFKG

SEQ ID NO: 1671 - protein, 11 aa, Artificial Sequence
  Description of Artificial Sequence: Synthetic peptide
LGNNYGIWFAY

SEQ ID NO: 1672 - protein, 107 aa, Artificial Sequence; identical to SEQ ID NO: 797
  Description of Artificial Sequence: Synthetic polypeptide

SEQ ID NO: 1673 - protein, 11 aa, Artificial Sequence
  Description of Artificial Sequence: Synthetic peptide
RASDDLYSTLA

SEQ ID NO: 1674 - protein, 7 aa, Artificial Sequence
  Description of Artificial Sequence: Synthetic peptide
DANRLAA

SEQ ID NO: 1675 - protein, 9 aa, Artificial Sequence
  Description of Artificial Sequence: Synthetic peptide
QQYNKFPWT

SEQ ID NO: 1676 - protein, 120 aa, Artificial Sequence; identical to SEQ ID NO: 795
  Description of Artificial Sequence: Synthetic polypeptide

SEQ ID NO: 1677 - protein, 10 aa, Artificial Sequence
  Description of Artificial Sequence: Synthetic peptide
GYTFTNYGMY

SEQ ID NO: 1678 - protein, 17 aa, Artificial Sequence
  Description of Artificial Sequence: Synthetic peptide
WINTETGQPTYADDFKG

SEQ ID NO: 1679 - protein, 11 aa, Artificial Sequence
  Description of Artificial Sequence: Synthetic peptide
LGNNYGIWFAY

SEQ ID NO: 1680 - protein, 107 aa, Artificial Sequence; identical to SEQ ID NO: 797
  Description of Artificial Sequence: Synthetic polypeptide

SEQ ID NO: 1681 - protein, 11 aa, Artificial Sequence
  Description of Artificial Sequence: Synthetic peptide
RASDDLYSTLA

SEQ ID NO: 1682 - protein, 7 aa, Artificial Sequence
  Description of Artificial Sequence: Synthetic peptide
DANRLAA

SEQ ID NO: 1683 - protein, 9 aa, Artificial Sequence
  Description of Artificial Sequence: Synthetic peptide
QQYNKFPWT

SEQ ID NO: 1684 - protein, 120 aa, Artificial Sequence; identical to SEQ ID NO: 795
  Description of Artificial Sequence: Synthetic polypeptide

SEQ ID NO: 1685 - protein, 10 aa, Artificial Sequence
  Description of Artificial Sequence: Synthetic peptide
GYTFTNYGMY

SEQ ID NO: 1686 - protein, 17 aa, Artificial Sequence
  Description of Artificial Sequence: Synthetic peptide
WINTETGQPTYADDFKG

SEQ ID NO: 1687 - protein, 11 aa, Artificial Sequence
  Description of Artificial Sequence: Synthetic peptide
LGNNYGIWFAY

SEQ ID NO: 1688 - protein, 107 aa, Artificial Sequence; identical to SEQ ID NO: 798
  Description of Artificial Sequence: Synthetic polypeptide

SEQ ID NO: 1689 - protein, 11 aa, Artificial Sequence
  Description of Artificial Sequence: Synthetic peptide
RASDDLYSTLA

SEQ ID NO: 1690 - protein, 7 aa, Artificial Sequence
  Description of Artificial Sequence: Synthetic peptide
DANRLAA

SEQ ID NO: 1691 - protein, 9 aa, Artificial Sequence
  Description of Artificial Sequence: Synthetic peptide
QQYNKFPWT

SEQ ID NO: 1692 - protein, 119 aa, Artificial Sequence; identical to SEQ ID NO: 800
  Description of Artificial Sequence: Synthetic polypeptide

SEQ ID NO: 1693 - protein, 10 aa, Artificial Sequence
  Description of Artificial Sequence: Synthetic peptide
GFTFSNYGMA

SEQ ID NO: 1694 - protein, 17 aa, Artificial Sequence
  Description of Artificial Sequence: Synthetic peptide
SITNSGGNTYYRDSVKG

SEQ ID NO: 1695 - protein, 10 aa, Artificial Sequence
  Description of Artificial Sequence: Synthetic peptide
HTPGANYFDY

SEQ ID NO: 1696 - protein, 106 aa, Artificial Sequence; identical to SEQ ID NO: 802
  Description of Artificial Sequence: Synthetic polypeptide

SEQ ID NO: 1697 - protein, 11 aa, Artificial Sequence
  Description of Artificial Sequence: Synthetic peptide
QASQSIKNYIA

SEQ ID NO: 1698 - protein, 7 aa, Artificial Sequence
  Description of Artificial Sequence: Synthetic peptide
YTSTLES

SEQ ID NO: 1699 - protein, 8 aa, Artificial Sequence
  Description of Artificial Sequence: Synthetic peptide
VQYANLYT

SEQ ID NO: 1700 - protein, 119 aa, Artificial Sequence; identical to SEQ ID NO: 799
  Description of Artificial Sequence: Synthetic polypeptide

SEQ ID NO: 1701 - protein, 10 aa, Artificial Sequence
  Description of Artificial Sequence: Synthetic peptide
GFTFSNYGMA

SEQ ID NO: 1702 - protein, 17 aa, Artificial Sequence
  Description of Artificial Sequence: Synthetic peptide
SITNSGGNTYYRDSVKG

SEQ ID NO: 1703 - protein, 10 aa, Artificial Sequence
  Description of Artificial Sequence: Synthetic peptide
HTPGANYFDY

SEQ ID NO: 1704 - protein, 106 aa, Artificial Sequence; identical to SEQ ID NO: 803
  Description of Artificial Sequence: Synthetic polypeptide

SEQ ID NO: 1705 - protein, 11 aa, Artificial Sequence
  Description of Artificial Sequence: Synthetic peptide
QASQSIKNYIA

SEQ ID NO: 1706 - protein, 7 aa, Artificial Sequence
  Description of Artificial Sequence: Synthetic peptide
YTSTLES

SEQ ID NO: 1707 - protein, 8 aa, Artificial Sequence
  Description of Artificial Sequence: Synthetic peptide
VQYANLYT

SEQ ID NO: 1708 - protein, 5 aa, Artificial Sequence
  Description of Artificial Sequence: Synthetic peptide
DDFKG

SEQ ID NO: 1709 - protein, 5 aa, Artificial Sequence
  Description of Artificial Sequence: Synthetic peptide
QGFTG

SEQ ID NO: 1710 - protein, 4 aa, Artificial Sequence
  Description of Artificial Sequence: Synthetic peptide
HMHW

SEQ ID NO: 1711 - protein, 4 aa, Artificial Sequence
  Description of Artificial Sequence: Synthetic peptide
YLAW

SEQ ID NO: 1712 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFTNYRMYWVRQAPGQGLEWMGWINTETGXPAYADDFKRRFVFSLDTSVSTAYLQISSLKAEDTAVYYCARTKYYYSSYIFYFDYWGQGTMVTVSS

SEQ ID NO: 1713 - protein, 123 aa, Artificial Sequence
  Description of Artificial Sequence: Synthetic polypeptide
EVQLVQSGSELKKPGASVKVSCKASGYTFTNYSMYWVRQAPGQGLEWMGWINTETGKPTYADDFKGRFVFSLDTSVSTAYLQISSLKAEDTAVYYCARTKYYYRFYLFYFDYWGQGTMVTVSS

SEQ ID NO: 1714 - protein, 123 aa, Artificial Sequence
  Description of Artificial Sequence: Synthetic polypeptide
EVQLVQSGSELKKPGASVKVSCKASGYTFTYYGMYWVRQAPGQGLEWMGWINTKTGKPTYADDFKGRFVFSLDTSVSTAYLQISSLKAEDTAVYYCARTNYYYGSYIFYFDYWGQGTMVTVSS

SEQ ID NO: 1715 - protein, 123 aa, Artificial Sequence
  Description of Artificial Sequence: Synthetic polypeptide
EVQLVQSGSELKKPGASVKVSCKASGYTFINYRMYWVRQAPGQGLEWMGWINTETGKPVYADDFKGRFVFSLDTSVSTAYLQISSLKAEDTAVYYCARTNYYYSSYKFYFDYWGQGTMVTVSS

SEQ ID NO: 1716 - protein, 123 aa, Artificial Sequence
  Description of Artificial Sequence: Synthetic polypeptide
  MOD_RES (104)..(104): Any amino acid
EVQLVQSGSELKKPGASVKVSCKASGYTFTNYAMYWVRQAPGQGLEWMGWINTETGKPTYAQGFTGRFVFSLDTSVSTAYLQISSLKAEDTAVYYCARTIYYYXKYIFYFDYWGQGTMVTVSS

SEQ ID NO: 1717 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYAQGFTGRFVFSLDTSVSTAYLQISSLKAEDTAVYYCARPTYYYWIYIFYFDYWGQGTMVTVSS

SEQ ID NO: 1718 - protein, 123 aa, Artificial Sequence
  Description of Artificial Sequence: Synthetic polypeptide
  MOD_RES (104)..(104): Any amino acid
EVQLVQSGSELKKPGASVKVSCKASGYTFTNYCMYWVRQAPGQGLEWMGWINTETGKPTYADDFKGRFVFSLDTSVSTAYLQISSLKAEDTAVYYCARRNYYYXCYIFYFDYWGQGTMVTVSS

SEQ ID NO: 1719 - protein, 123 aa, Artificial Sequence
  Description of Artificial Sequence: Synthetic polypeptide
EVQLVQSGSELKKPGASVKVSCKASGYTFTTYDMYWVRQAPGQGLEWMGWINTVTGSPAYADDFKGRFVFSLDTSVSTAYLQISSLKAEDTAVYYCARTTYYYCSYTFYFDYWGQGTMVTVSS

SEQ ID NO: 1720 - protein, 123 aa, Artificial Sequence
  Description of Artificial Sequence: Synthetic polypeptide
  MOD_RES (57)..(57): Any amino acid
  MOD_RES (99)..(99): Any amino acid
  MOD_RES (104)..(104): Any amino acid
  MOD_RES (107)..(107): Any amino acid
EVQLVQSGSELKKPGASVKVSCKASGYTFTNYGMYWVRQAPGQGLEWMGWINTGTGXPTYAQGFTGRFVFSLDTSVSTAYLQISSLKAEDTAVYYCARXNYYYXSYXFYFDYWGQGTMVTVSS

SEQ ID NO: 1721 - protein, 123 aa, Artificial Sequence
  Description of Artificial Sequence: Synthetic polypeptide
EVQLVQSGSELKKPGASVKVSCKASGYTFSKYGMYWVRQAPGQGLEWMGWINTYTGKPLYADDFKGRFVFSLDTSVSTAYLQISSLKAEDTAVYYCARTNYYYMGYRFYFDYWGQGTMVTVSS

SEQ ID NO: 1722 - protein, 123 aa, Artificial Sequence
  Description of Artificial Sequence: Synthetic polypeptide
EVQLVQSGSELKKPGASVKVSCKASGYTFTPYGMYWVRQAPGQGLEWMGWINTETGVPSYAQGFTGRFVFSLDTSVSTAYLQISSLKAEDTAVYYCARSNYYYRSYRFYFDYWGQGTMVTVSS

SEQ ID NO: 1723 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFINYVMYWVRQAPGQGLEWMGWINTATGXPSYAQGFTGRFVFSFDTSVSTTYLQISSLKAEDTAVYYCARTTYYYRRYIFYFDYWGQGTMVTVSS

SEQ ID NO: 1724 - protein, 123 aa, Artificial Sequence
  Description of Artificial Sequence: Synthetic polypeptide
EVQLVQSGSELKKPGASVKVSCKASGYTFTKYDMYWVRQAPGQGLEWMGWINTATGKPTYADDFKGRFVFSLDTSVSTAYLQISSLKAEDTAVYYCARTLYYYRRYIFYFDYWGQGTMVTVSS

SEQ ID NO: 1725 - protein, 123 aa, Artificial Sequence
  Description of Artificial Sequence: Synthetic polypeptide
EVQLVQSGSELKKPGASVKVSCKASGYTFIKYGMYWVRQAPGQGLEWMGWINTETGRPAYADDFKGRFVFSLDTSVSTAYLQISSLKAEDTAVYYCARIRYYYGSYIFYFDYWGQGTMVTVSS

SEQ ID NO: 1726 - protein, 123 aa, Artificial Sequence
  Description of Artificial Sequence: Synthetic polypeptide
EVQLVQSGSELKKPGASVKVSCKASGYTFKNYEMYWVRQAPGQGLEWMGWINTETGKPRYADDFKGRFVFSLDTSVNTAYLQISSLKAEDTAVYYCARTNYYYRSYVFYFDYWGQGTMVTVSS

SEQ ID NO: 1727 - protein, 123 aa, Artificial Sequence
  Description of Artificial Sequence: Synthetic polypeptide
EVQLVQSGSELKKPGASVKVSCKASGYTFPLYSMYWVRQAPGQGLEWMGWINTHTGNPSYADDFKGRFVFSLDTSVSTAYLQISSLKAEDTAVYYCARTNYYYRSYTFYFDYWGQGTMVTVSS

SEQ ID NO: 1728 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTATGKPTYADDFKGRFVFSLDTSVSTAYLQISSLKAEDTAVYYCARMNYYYRSYIFYFDYWGQGTMVTVSS

SEQ ID NO: 1729 - protein, 123 aa, Artificial Sequence
  Description of Artificial Sequence: Synthetic polypeptide
EVQLVQSGSELKKPGASVKVSCKASGYTFTNYCMYWVRQAPGQGLEWMGWINTETGKPLYAQGFTGRFVFSLDTSVSTAYLQISSLKAEDTAVYYCARRNYYYGGYIFYFDYWGQGTMVTVSS

SEQ ID NO: 1730 - protein, 123 aa, Artificial Sequence
  Description of Artificial Sequence: Synthetic polypeptide
  MOD_RES (31)..(31): Any amino acid
EVQLVQSGSELKKPGASVKVSCKASGYTFTXYGMYWVRQAPGQGLEWMGWINTQTGPPPYADDFKGRFVFSLDTSVSTAYLQISSLKAEDTAVYYCARTYYYYRWYIFYFDYWGQGTMVTVSS

SEQ ID NO: 1731 - protein, 123 aa, Artificial Sequence
  Description of Artificial Sequence: Synthetic polypeptide
  MOD_RES (62)..(62): Any amino acid
  MOD_RES (99)..(100): Any amino acid
  MOD_RES (104)..(104): Any amino acid
EVQLVQSGSELKKPGASVKVSCKASGYTFTIYEMYWVRQAPGQGLEWMGWINTETGTPPYAXDFTGRFVFSLDTSVSTAYLQISSLKAEDTAVYYCARXXYYYXSYIFYFDYWGQGTMVTVSS

SEQ ID NO: 1732 - protein, 123 aa, Artificial Sequence
  Description of Artificial Sequence: Synthetic polypeptide
EVQLVQSGSELKKPGASVKVSCKASGYTFTNYVMYWVRQAPGQGLEWMGWINTDTGNPAYAQGFTGRFVFSLDTSVSTAYLQISSLKAEDTAVYYCARTTYYYRVYMFYFDYWGQGTMVTVSS

SEQ ID NO: 1733 - protein, 123 aa, Artificial Sequence
  Description of Artificial Sequence: Synthetic polypeptide
EVQLVQSGSELKKPGASVKVSCKASGYTFTNYCMYWVRQAPGQGLEWMGWINTATGNPSYADDFKGRFVFSLDTSVSTAYLQISSLKAEDTAVYYCARTNYYYASYIFYFDYWGQGTMVTVSS

SEQ ID NO: 1734 - protein, 123 aa, Artificial Sequence
  Description of Artificial Sequence: Synthetic polypeptide
EVQLVQSGSELKKPGASVKVSCKASGYTFTNYAMYWVRQAPGQGLEWMGWINTPTGMPNYAQGFTGRFVFSLDTSVSTAYLQISSLKAEDTAVYYCARTSYYYSSYLFYFDYWGQGTMVTVSS

SEQ ID NO: 1735 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTDTGTPTYADDFKGRFVFSLDTSVSTAYLQISSLKAEDTAVYYCARTEYYYRSYIFYFDYWGQGTMVTVSS

SEQ ID NO: 1736 - protein, 123 aa, Artificial Sequence
  Description of Artificial Sequence: Synthetic polypeptide
EVQLVQSGSELKKPGASVKVSCKASGYTFTNYEMYWVRQAPGQGLEWMGWINTATGKPSYADDFKGRFVFSLDTSVSTAYLQISSLKAEDTAVYYCARTIYYYVRYIFYFDYWGQGTMVTVSS

SEQ ID NO: 1737 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGTPSYADDFKGRFVFSLDTSVSTAYLQISSLKAEDTAVYYCARTVYYYRSYLFYFDYWGQGTMVTVSS

SEQ ID NO: 1738 - protein, 123 aa, Artificial Sequence
  Description of Artificial Sequence: Synthetic polypeptide
EVQLVQSGSELKKPGASVKVSCKASGYTFATYGMYWVGQAPGQGLEWMGWINTETGMPAYADDFKGRFVFSLDTSVSTAYLQISSLKAEDTAVYYCARIRYYYGRYLFYFDYWGQGTMVTVSS

SEQ ID NO: 1739 - protein, 123 aa, Artificial Sequence
  Description of Artificial Sequence: Synthetic polypeptide
EVQLVQSGSELKKPGASVKVSCKASGYTFSIYYMYWVRQAPGQGLEWMGWINTGTGTPTYADDFKGRFVFSLDTSVSTAYLQISSLKAEDTAVYYCARTSYYYRSYLFYFDYWGQGTMVTVSS

SEQ ID NO: 1740 - protein, 123 aa, Artificial Sequence
  Description of Artificial Sequence: Synthetic polypeptide
EVQLVQSGSELKKPGASVKVSCKASGYTFTNYAMYWVRQAPGQGLEWMGWINTQTGKPRYAQGFTGRFVFSLDTSVSTAYLQISSLKAEDTAVYYCARPQYYYTSYIFYFDYWGQGTMVTVSS

SEQ ID NO: 1741 - protein, 123 aa, Artificial Sequence
  Description of Artificial Sequence: Synthetic polypeptide
  MOD_RES (54)..(54): Any amino acid
  MOD_RES (57)..(57): Any amino acid
  MOD_RES (62)..(62): Any amino acid
  MOD_RES (99)..(100): Any amino acid
  MOD_RES (107)..(107): Any amino acid
EVQLVQSGSELKKPGASVKVSCKASGYTFTNYGMYWVRQAPGQGLEWMGWINTXTGXPTYAXDFKGRFVFSLDTSVSTAYLQISSLKAEDTAVYYCARXXYYYRSYXFYFDYWGQGTMVTVSS

SEQ ID NO: 1742 - protein, 123 aa, Artificial Sequence
  Description of Artificial Sequence: Synthetic polypeptide
EVQLVQSGSELKKPGASVKVSCKASGYTFTYYNMYWVRQAPGQGLEWMGWINTATGSPTYADDFKGRFVFSLDTSVSTAYLQISSLKAEDTAVYYCARSTYYYRSYIFYFDYWGQGTMVTVSS

SEQ ID NO: 1743 - protein, 123 aa, Artificial Sequence
  Description of Artificial Sequence: Synthetic polypeptide
EVQLVQSGSELKKPGASVKVSCKASGYTFTKYGMYWVRQAPGQGLEWMGWINTQTGKPRYADDFKGRFVFSLDTSVSTAYLQISSLKAEDTAVYYCARTNYYYWSYIFYFDYWGQGTMVTVSS

SEQ ID NO: 1744 - protein, 123 aa, Artificial Sequence
  Description of Artificial Sequence: Synthetic polypeptide
  MOD_RES (57)..(57): Any amino acid
  MOD_RES (99)..(100): Any amino acid
  MOD_RES (104)..(104): Any amino acid
EVQLVQSGSELKKPGASVKVSCKASGYTFTNYPMYWVRQAPGQGLEWMGWINTETGXPTYADDFKGRFVFSLDTSVSTAYLQISSLKAEDTAVYYCARXXYYYXRYIFYFDYWGQGTMVTVSS

SEQ ID NO: 1745 - protein, 123 aa, Artificial Sequence
  Description of Artificial Sequence: Synthetic polypeptide
EVQLVQSGSELKKPGASVKVSCKASGYTFTNYDMYWVRQAPGQGLEWMGWINTATGKPTYADDFKGRFVFSLDTSVSTAYLQISSLKAEDTAVYYCARANYYYRSYLFYFDYWGQGTMVTVSS

SEQ ID NO: 1746 - protein, 123 aa, Artificial Sequence
  Description of Artificial Sequence: Synthetic polypeptide
EVQLVQSGSELKKPGASVKVSCKASGYTFAHYGMYWVRQAPGQGLEWMGWINTETGNPDYAQGFTGRFVFSLDTSVSTAYLQISSLKAEDTAVYYCARTNYYYRCYIFYFDYWGQGTMVTVSS

SEQ ID NO: 1747 - protein, 123 aa, Artificial Sequence
  Description of Artificial Sequence: Synthetic polypeptide
EVQLVQSGSELKKPGASVKVSCKASGYTFTIYGMYWVRQAPGQGLEWMGWINTETGKPTYAQGFTGRFVFSLDTSVSTAYLQISSLKAEDTAVYYCARTNYYYRCYMFYFDYWGQGTMVTVSS

SEQ ID NO: 1748 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTVTGAPIYAQGFTGRFVFSLDTSVSTAYLQISSLKAEDTAVYYCARTNYYYWGYRFYFDYWGQGTMVTVSS

SEQ ID NO: 1749 - protein, 123 aa, Artificial Sequence
  Description of Artificial Sequence: Synthetic polypeptide
EVQLVQSGSELKKPGASVKVSCKASGYTFRSYVMYWVRQAPGQGLEWMGWINTDTGTPSYAQGFTGRFVFSLDTSVSTAYLQISSLKAEDTAVYYCARPYYYYRRYIFYFDYWGQGTMVTVSS

SEQ ID NO: 1750 - protein, 123 aa, Artificial Sequence
  Description of Artificial Sequence: Synthetic polypeptide
  MOD_RES (99)..(99): Any amino acid
EVQLVQSGSELKKPGASVKVSCKASGYTFTNYCMYWVRQAPGQGLEWMGWINTKTGNPAYAQGFTGRFVFSLDTSVSTAYLQISSLKAEDTAVYYCARXIYYYRRYVLYFDYWGQGTMVTVSS

SEQ ID NO: 1751 - protein, 123 aa, Artificial Sequence
  Description of Artificial Sequence: Synthetic polypeptide
EVQLVQSGSELKKPGASVKVSCKASGYTFANYSMYWVRQAPGQGLEWMGWINTETGKPKYAQGFTGRFVFSLDTSVSTAYLQISSLKAEDTAVYYCARTNYYYRRYSFYFDYWGQGTMVTVSS

SEQ ID NO: 1752 - protein, 123 aa, Artificial Sequence
  Description of Artificial Sequence: Synthetic polypeptide
EVQLVQSGSELKKPGASVKVSCKASGYTFTNYCMYWVRQAPGQGLEWMGWINTTTGKPNYAQGFTGRFVFSLDTSVSTAYLQISSLKAEDTAVYYCARSNYYYRRYLFYFDYWGQGTMVTVSS

SEQ ID NO: 1753 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTMTGKPNYAQGFTGRFVFSLDTSVSTAYLQISSLKAEDTAVYYCARTDYYYRSYDFYFDYWGQGTMVTVSS

SEQ ID NO: 1754 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFPKYAMYWVRQAPGQGLEWMGWINTETGXPRYAHDFTGRFVFSLDTSVSTAYLQISSLKAEDTAVYYCARTNYYYRGYIFYFDYWGQGTMVTVSS

SEQ ID NO: 1755 - protein, 123 aa, Artificial Sequence
  Description of Artificial Sequence: Synthetic polypeptide
EVQLVQSGSELKKPGASVKVSCKASGYTFSNYVMYWVRQAPGQGLEWMGWINTETGTPMYAQGFTGRFVFSLDTSVSTAYLQISSLKAEDTAVYYCARRDYYYRRYVFYFDYWGQGTMVTVSS

SEQ ID NO: 1756 - protein, 123 aa, Artificial Sequence
  Description of Artificial Sequence: Synthetic polypeptide
EVQLVQSGSELKKPGASVKVSCKASGYTFTKYDMYWVRQVPGQGLEWMGWVNTDTGKPPYAQGFTGRFVFSLDTSVSTAYLQISSLKAEDTAVYYCARSKYYYWTYVFYFDYWGQGTMVTVSS

SEQ ID NO: 1757 - protein, 123 aa, Artificial Sequence
  Description of Artificial Sequence: Synthetic polypeptide
  MOD_RES (54)..(54): Any amino acid
EVQLVQSGSELKKPGASVKVSCKASGYTFTYYDMYWVRQAPGQGLEWMGWINTXTGKPIYADDFKGRFVFSLDTSVSTAYLQISSLKAEDTAVYYCARTIYYYGRYSFYFDYWGQGTMVTVSS

SEQ ID NO: 1758 - protein, 123 aa, Artificial Sequence
  Description of Artificial Sequence: Synthetic polypeptide
EVQLVQSGSELKKPGASVKVSCKASGYTFPFYVMYWVRQAPGQGLEWMGWINTETGKPTYADDFKGRFVFSLDTSVSTAYLQISSLKAEDTAVYYCARTNYYYRRYIFYFDYWGQGTMVTVSS

SEQ ID NO: 1759 - protein, 123 aa, Artificial Sequence
  Description of Artificial Sequence: Synthetic polypeptide
EVQLVQSGSELKKPGASVKVSCKASGYTFTTYSMYWVRQAPGQGLEWMGWINTKTGKPTYAQGFTGRFVFSLDTSVSTAYLQISSLKAEDTAVYYCARTIYYYMCYVFYFDYWGQGTMVTVSS

SEQ ID NO: 1760 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGNPTYAQGFTGRFVFSLDTSVSTAYLQISSLKAEDTAVYYCARKHYYYGSYLFYFDYWGQGTMVTVSS

SEQ ID NO: 1761 - protein, 123 aa, Artificial Sequence
  Description of Artificial Sequence: Synthetic polypeptide
EVQLVQSGSELKKPGASVKVSCKASGYTFPDYDMYWVRQAPGQGLEWMGWINTETGMPTYAQGFTGRFVFSLDTSVSTAYLQISSLKAEDTAVYYCARTNYYYRGYIFYFDYWGQGTMVTVSS

SEQ ID NO: 1762 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTDTGKPTYAQGFTGRFVFSLDTSVSTAYLQISSLKAEDTAVYYCARTYYYYKKYIFYFDYWGQGTMVTVSS

SEQ ID NO: 1763 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTGTGRPTYAQGFTGRFVFSLDTSVSTAYLQISSLKAEDTAVYYCARTQYYYRRYIFYFDYWGQGTMVTVSS

SEQ ID NO: 1764 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTKTGKPTYAQGFTGRFVFSLDTSVSTAYLQISSLKAEDTAVYYCARKNYYYKSYVFYFDYWGQGTMVTVSS

SEQ ID NO: 1765 - protein, 123 aa, Artificial Sequence
  Description of Artificial Sequence: Synthetic polypeptide
EVQLVQSVSELKKPGASVKVSCKASGYTFTKYTMYWVRQAPGQGLEWMGWINTETGNPMYADDFKGRFVFSLDTSVSTAYLQISSLKAEDTAVYYCARTNYYYRIYIFYFDYWGQGTMVTVSS

SEQ ID NO: 1766 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTATGKPTYADDFKGRFVFSLDTSVSTAYLQISSLKAEDTAVYYCARSSYYYRNYIFYFDYWGQGTMVTVSS

SEQ ID NO: 1767 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTVTGKPDYADDFKGRFVFSLDTSVSTAYLQISSLKAEDTAVYYCARQKYYYRSYFFYFDYWGQGTMVTVSS

SEQ ID NO: 1768 - protein, 123 aa, Artificial Sequence
  Description of Artificial Sequence: Synthetic polypeptide
  MOD_RES (105)..(105): Any amino acid
EVQLVQSGSELKKPGASVKVSCKASGYTFTNYDMYWVRQAPGQGLEWMGWINTDTGKPAYADDFKGRFVFSLDTSVSTAYLQISSLKAEDTAVYYCARPSYYYVXYIFYFDYWGQGTMVTVSS

SEQ ID NO: 1769 - protein, 123 aa, Artificial Sequence
  Description of Artificial Sequence: Synthetic polypeptide
  MOD_RES (33)..(33): Any amino acid
  MOD_RES (100)..(100): Any amino acid
EVQLVQSGSELKKPGASVKVSCKASGYTFTLYXMYWVRQAPGQGLEWMGWINTATGKPTYAHDFTGRFVFSLDTSVSTAYLQISSLKAEDTAVYYCARTXYYYRSYIFYFDYWGQGTMVTVSS

SEQ ID NO: 1770 - protein, 123 aa, Artificial Sequence
  Description of Artificial Sequence: Synthetic polypeptide
EVQLVQSGSELKKPGASVKVSCKASGYTFTKYGMYWVRQAPGQGLEWMGWINTHTGNPTYADDFKGRFVFSLDTSVSTAYLQISSLKAEDTAVYYCARTNYYYRCYIFYFDYWGQGTMVTVSS

SEQ ID NO: 1771 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPEYADDFKGRFVFSLDTSVSTAYLQISSLKAEDTAVYYCARPNYYYRSYFFYFDYWGQGTMVTVSS

SEQ ID NO: 1772 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGRPGYAQGFTGRFVFSLDTSVSTAYLQISSLKAEDTAVYYCARLWYYYWMYIFYFDYWGQGTMVTVSS

SEQ ID NO: 1773 - protein, 123 aa, Artificial Sequence
  Description of Artificial Sequence: Synthetic polypeptide
EVQLVQSGSELKKPGASVKVSCKASGYTFTYYGMYWVRQAPGQGLEWMGWINTETGTPTYAQGFTGRFVFSLDTSVSTAYLQISSLKAEDTAVYYCARVYYYYGSYSFYFDYWGQGTMVTVSS

SEQ ID NO: 1774 - protein, 123 aa, Artificial Sequence
  Description of Artificial Sequence: Synthetic polypeptide
  MOD_RES (54)..(54): Any amino acid
EVQLVQSGSELKKPGASVKVSCKASGYTFVNYAMYWVRQAPGQGLEWMGWINTXTGKPTYADDFKGRFVFSLDTSVSTAYLQISSLKAEDTAVYYCARKTYYYRGYIFYFDYWGQGTMVTVSS

SEQ ID NO: 1775 - protein, 123 aa, Artificial Sequence
  Description of Artificial Sequence: Synthetic polypeptide
EVQLVQSGSELKKPGASVKVSCKASGYTFTHYYMYWVRQAPGQGLEWMGWINTETGKPTYADDFKGRFVFSLDTSVSTAYLQISSLKAEDTAVYYCARSKYYYRSYTFYFDYWGQGTMVTVSS

SEQ ID NO: 1776 - protein, 123 aa, Artificial Sequence
  Description of Artificial Sequence: Synthetic polypeptide
EVQLVQSGSELKKPGASVKVSCKASGYTFLHYGMYWVRQAPGQGLEWMGWINTETGWPRYAQGFTGRFVFSLDTSVSTAYLQISSLKAEDTAVYYCARTSYYYVSYIFYFDYWGQGTMVTVSS

SEQ ID NO: 1777 - protein, 123 aa, Artificial Sequence
  Description of Artificial Sequence: Synthetic polypeptide
  MOD_RES (100)..(100): Any amino acid
EVQLVQSGSELKKPGASVKVSCKASGYTFTIYGMYWVRQAPGQGLEWMGWINTATGKPTYADDFKGRFVFSLDTSVSTAYLQISSLKAEDTAVYYCARTXYYYRSYVFYFDYWGQGTMVTVSS

SEQ ID NO: 1778 - protein, 123 aa, Artificial Sequence
  Description of Artificial Sequence: Synthetic polypeptide
  MOD_RES (107)..(107): Any amino acid
EVQLVQSGSELKKPGASVKVSCKASGYTFTNYGMYWVRQAPGQGLEWMGWINTETGNPIYAQGFTGRFVFSLDTSVSTAYLQISSLKAEDTAVYYCARAHYYYRTYXFYFDYWGQGTMVTVSS

SEQ ID NO: 1779 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGNPIYAQGFTGRFVFSLDTSVSTAYLQISSLKAEDTAVYYCARAHYYYRTYNFYFDYWGQGTMVTVSS

SEQ ID NO: 1780 - protein, 123 aa, Artificial Sequence
  Description of Artificial Sequence: Synthetic polypeptide
EVQLVQSGSELKKPGASVKVSCKASGYTFSNYWMYWVRQAPGQGLEWMGWINTETGRPRYADDFKGRFVFSLDTSVSTAYLQISSLKAEDTAVYYCARVYYYYRCYSFYFDYWGQGTMVTVSS

SEQ ID NO: 1781 - protein, 123 aa, Artificial Sequence
  Description of Artificial Sequence: Synthetic polypeptide
EVQLVQSGSELKKPGASVKVSCKASGYTFTHYWMYWVRQAPGQGLEWMGWINTETGTPSYAQGFTGRFVFSLDTSVSTAYLQISSLKAEDTAVYYCARTTYYYRSYIFYFDYWGQGTMVTVSS

SEQ ID NO: 1782 - protein, 123 aa, Artificial Sequence
  Description of Artificial Sequence: Synthetic polypeptide
EVQLVQSGSELKKPGASVKVSCKASGYTFTKYGMYWVRQAPGQGLEWMGWINTNTGKPTYAQGFTGRFVFSLDTSVSTAYLQISSLKAEDTAVYYCARAYYYYWSYIFYFDYWGQGTMVTVSS

SEQ ID NO: 1783 - protein, 123 aa, Artificial Sequence
  Description of Artificial Sequence: Synthetic polypeptide
EVQLVQSGSELKKPGASVKVSCKASGYTFTSYVMYWVRQAPGQGLEWMGWINTKTGMPTYADDFKGRFVFSLDTSVSTAYLQISSLKAEDTAVYYCARTTYYYMSYIFYFDYWGQGTMVTVSS

SEQ ID NO: 1784 - protein, 123 aa, Artificial Sequence
  Description of Artificial Sequence: Synthetic polypeptide
EVQLVQSGSELKKPGASVKVSCKASGYTFTQYGMYWVRQAPGQGLEWMGWINTETGKPKYAQGFTGRFVFSLDTSVSTAYLQISSLKAEDTAVYYCARTNYYYWSYKFYFDYWGQGTMVTVSS

SEQ ID NO: 1785 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFSTYMMYWVRQAPGQGLEWMGWINTETGXPTYADDFKGRFVFSLDTSVSTAYLQISSLKAEDTAVYYCARSNYYYRSYIFYFDYWGQGTMVTVSS

SEQ ID NO: 1786 - protein, 123 aa, Artificial Sequence
  Description of Artificial Sequence: Synthetic polypeptide
EVQLVQSGSELKKPGASVKVSCKASGYTFMNYVMYWVRQAPGQGLEWMGWINTKTGMPRYAQGFTGRFVFSLDTSVSTAYLQISSLKAEDTAVYYCARTNYYYMRYIFYFDYWGQGTMVTVSS

SEQ ID NO: 1787 - protein, 123 aa, Artificial Sequence
  Description of Artificial Sequence: Synthetic polypeptide
EVQLVQSGSELKKPGASVKVSCKASGYTFTTYGMYWVRQAPGQGLEWMGWINTQTGEPPYAQGFTGRFVFSLDTSVSTAYLQISSLKAEDTAVYYCARTGYYYWNYLFYFDYWGQGTMVTVSS

SEQ ID NO: 1788 - protein, 123 aa, Artificial Sequence
  Description of Artificial Sequence: Synthetic polypeptide
EVQLVQSGSELKKPGASVKVSCKASGYTFTNYRMYWVRQAPGQGLEWMGWINTETGKPPYADDFKGRFVFSLDTSVSTAYLQISSLKAEDTAVYYCARTNYYYMSYIFYFDYWGQGTMVTVSS

SEQ ID NO: 1789 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGSPRYAQGFTGRFVFSLDTSVSTAYLQISSLKAEDTAVYYCARTNYYYVSYIFYFDYWGQGTMVTVSS

SEQ ID NO: 1790 - protein, 123 aa, Artificial Sequence
  Description of Artificial Sequence: Synthetic polypeptide
  MOD_RES (57)..(57): Any amino acid
  MOD_RES (99)..(99): Any amino acid
  MOD_RES (104)..(105): Any amino acid
EVQLVQSGSELKKPGASVKVSCKASGYTFTNYGMYWVRQAPGQGLEWMGWINTETGXPTYAHDFTGRFVFSLDTSVSTAYLQISSLKAEDTAVYYCARXNYYYXXYIFYFDYWGQGTMVTVSS

SEQ ID NO: 1791 - protein, 123 aa, Artificial Sequence
  Description of Artificial Sequence: Synthetic polypeptide
EVQLVQSGSELKKPGASVKVSCKASGYTFTIYGMYWVRQAPGQGLEWMGWINTDTGRPIYAQGFTGRFVFSLDTSVSTAYLQISSLKAEDTAVYYCARIIYYYCSYIFYFDYWGQGTMVTVSS

SEQ ID NO: 1792 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTETGKPTYAQGFTGRFVFSLDTSVSTAYLQISSLKAEDTAVYYCARTNYYYRSYIFYFDYWGQGTMVTVSS

SEQ ID NO: 1793 - protein, 123 aa, Artificial Sequence
  Description of Artificial Sequence: Synthetic polypeptide
EVQLVQSGSELKKPGASVKVSCKASGYTFSLYAMYWVRQAPGQGLEWMGWINTETGKPTYADDFKGQFVFSLDTSVSTAYLQISSLKAEDTAVYYCARTNYYYRSYNFYFDYWGQGTMVTVSS

SEQ ID NO: 1794 - protein, 123 aa, Artificial Sequence; identical to SEQ ID NO: 17
  Description of Artificial Sequence: Synthetic polypeptide

SEQ ID NO: 1795 - protein, 123 aa, Artificial Sequence
  Description of Artificial Sequence: Synthetic polypeptide
  MOD_RES (13)..(13): Any amino acid
  MOD_RES (30)..(30): Any amino acid
  MOD_RES (34)..(34): Any amino acid
EVQLVQSGSELNXPGASLKVSCKASGYTFXNYGXYWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 1796 - protein, 123 aa, Artificial Sequence
  Description of Artificial Sequence: Synthetic polypeptide
EVQLVQSGSELKKPGASVKVSCKASGYTFTNYGIYWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 1797 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARTNYYYRLYMFYFDYWGQGTMVTVSS

SEQ ID NO: 1798 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARTNYYYQSYMFYFDYWGQGTMVTVSS

SEQ ID NO: 1799 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTETGEPSYADDFKGRFVFSLDTSVSTAYLQISSLKAEDTAVYYCARTNYYYPSYMFYFDYWGQGTMVTVSS

SEQ ID NO: 1800 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYAQGFTGRFVFSLDTSVSTAYLQISSLKAEDTAVYYCARANYYYRTYMFYFDYWGQGTMVTVSS

SEQ ID NO: 1801 - protein, 123 aa, Artificial Sequence
  Description of Artificial Sequence: Synthetic polypeptide
EVQLVQSGSELKKPGASVKVSCKASGYTFADYGMYWVRQAPGQGLEWMGWINTETGEPTYADDFKGRFVFSLDTSVSTAYLQISSLKAEDTAVYYCARSNYYYRTYMFYFDYWGQGTMVTVSS

SEQ ID NO: 1802 - protein, 123 aa, Artificial Sequence
  Description of Artificial Sequence: Synthetic polypeptide
  MOD_RES (57)..(57): Any amino acid
  MOD_RES (62)..(62): Any amino acid
  MOD_RES (100)..(100): Any amino acid
  MOD_RES (104)..(104): Any amino acid
  MOD_RES (107)..(107): Any amino acid
EVQLVQSGSELKKPGASVKVSCKASGYTFTTYGMYWVRQAPGQGLEWMGWINTETGXPTYAXDFKGRFVFSLDTSVSTAYLQISSLKAEDTAVYYCARRXYYYXSYXFYFDYWGQGTMVTVSS

SEQ ID NO: 1803 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTETGEPTYADDFKGRFVFSLDTSVSTAYLQISSLKAEDTAVYYCARTNYYYPSYMFYFDYWGQGTMVTVSS

SEQ ID NO: 1804 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGQPTYAQGFTGRFVFSLDTSVSTAYLQISSLKAEDTAVYYCARTNYYYPSYMFYFDYWGQGTMVTVSS

SEQ ID NO: 1805 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARVNYYYRNYMFYFDYWGQGTMVTVSS

SEQ ID NO: 1806 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWINTETGEPTYADDFKGRFVFSLDTSVSTAYLQISSLKAEDTAVYYCARVNYYYMSYMFYFDYWGQGTMVTVSS

SEQ ID NO: 1807 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYAQGFTGRFVFSLDTSVSTAYLQISSLKAEDTAVYYCARTNYYYRMYMFYFDYWGQGTMVTVSS

SEQ ID NO: 1808 - protein, 123 aa, Artificial Sequence
  Description of Artificial Sequence: Synthetic polypeptide
EVQLVQSGSELKKPGASVKVSCKASGYTFLNYGMYWVRQAPGQGLEWMGWINTETGKPTYAQGFTGRFVFSLDTSVSTAYLQISSLKAEDTAVYYCARTKYYYWRYIFYFDYWGQGTMVTVSS

SEQ ID NO: 1809 - protein, 123 aa, Artificial Sequence
  Description of Artificial Sequence: Synthetic polypeptide
EVQLVQSGSELKKPGASVKVSCKASGYTFNDYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1810 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARINYYYRSYMFYFDYWGQGTMVTVSS

SEQ ID NO: 1811 - protein, 123 aa, Artificial Sequence
  Description of Artificial Sequence: Synthetic polypeptide
  MOD_RES (57)..(59): Any amino acid
  MOD_RES (99)..(99): Any amino acid
  MOD_RES (104)..(105): Any amino acid
EVQLVQSGSELKKPGASVKVSCKASGYTFMNYGMYWVRQAPGQGLEWMGWIDTETGXXXYAHDFTGRFVFSLDTSVSTAYLEISSLKAEDTAVYYCARXNYYYXXYMFYFDYWGQGTMVTVSS

SEQ ID NO: 1812 - protein, 123 aa, Artificial Sequence
  Description of Artificial Sequence: Synthetic polypeptide
EVQLVQSGSELKKPGASVKVSCKASGYTFTSYGMYWVRQAPGQGLEWMGWINTETGQPMYADDFKGRFVFSLDTSVSTAYLQISSLKAEDTAVYYCARRIYYYRCYLFYFDYWGQGTMVTVSS

SEQ ID NO: 1813 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTDTGMPTYADDFKGRFVFSLDTSVSTAYLQISSLKAEDTAVYYCARANYYYRSYMFYFDYWGQGTMVTVSS

SEQ ID NO: 1814 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTETGEPTYADDFKGRFVFSLDTSVSTAYLQISSLKAEDTAVYYCARTNYYYRNYMFYFDYWGQGTMVTVSS

SEQ ID NO: 1815 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPSYADDFKGRFVFSLDTSVSTAYLQISSLKAEDTAVYYCARSNYYYRSYMFYFDYWGQGTMVTVSS

SEQ ID NO: 1816 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFKGRFVFSLDTSVSTAYLQISSLKAEDTAVYYCARTNYYYKSYMFYFDYWGQGTMVTVSS

SEQ ID NO: 1817 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARANYYYRSYMFYFDYWGQGTMVTVSS

SEQ ID NO: 1818 - protein, 123 aa, Artificial Sequence
  Description of Artificial Sequence: Synthetic polypeptide
EVQLVQSGSELKKPGASVKVSCKASGYTFNYYGMYWVRQAPGQRLEWMGWINTETGEPTYADDFKGRFVFSLDTSVSTAYLQISSLKAEDTAVYYCARTNYYYESYMFYFDYWGQGTMVTVSS

SEQ ID NO: 1819 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTDTGEPTYADDFKGRFVFSLDTSVSTAYLQISSLKAEDTAVYYCARTNYYYRSYMFYFDYWGQGTMVTVSS

SEQ ID NO: 1820 - protein, 123 aa, Artificial Sequence
  Description of Artificial Sequence: Synthetic polypeptide
EVQLVQSGSELKKPGASVKVSCKASGYTFTKYRMYWVRQAPGQGLEWMGWINTVTGKPKYADDFTGRFVFSLDTSVSTAYLQISSLKAEDTAVYYCARFKYYYGSYFFYFDYWGQGTMVTVSS

SEQ ID NO: 1821 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGQPTYADDFKGRFVFSLDTSVSTAYLQISSLKAEDTAVYYCARTNYYYPSYMFYFDYWGQGTMVTVSS

SEQ ID NO: 1822 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYAQGFTGRFVFSLDTSVSTAYLQISSLKAEDTAVYYCARTNYYYRNYMFYFDYWGQGTMVTVSS

SEQ ID NO: 1823 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGDPTYADDFKGRFVFSLDTSVSTAYLQISSLKAEDTAVYYCARTNYYYRSYMFYFDYWGQGTMVTVSS

SEQ ID NO: 1824 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWIDTETGQPTYADDFKGRFVFSLDTSVSTAYLQISSLKAEDTAVYYCARTNYYYPRYMFYFDYWGQGTMVTVSS

SEQ ID NO: 1825 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTDTGEPTYAQGFTGRFVFSLDTSVSTAYLQISSLKAEDTAVYYCARTNYYYASYMFYFDYWGQGTMVTVSS

SEQ ID NO: 1826 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYQSYMFYFDYWGQGTMVTVSS

SEQ ID NO: 1827 - protein, 123 aa, Artificial Sequence
  Description of Artificial Sequence: Synthetic polypeptide
EVQLVQSGSELKKPGASVKVSCKASGYTFSHYGMYWVRQAPGQGLEWMGWINTETGSPTYADDFKGRFVFSLDTSVSTAYLQISSLKAEDTAVYYCARTNYYYPSYMFYFDYWGQGTMVTVSS

SEQ ID NO: 1828 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTDTGEPTYADDFKGRFVFSLDTSVSTAYLQISSLKAEDTAVYYCARTNYYYPSYMFYFDYWGQGTMVTVSS

SEQ ID NO: 1829 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGNPTYADDFKGRFVFSLDTSVSTAYLQISSLKAEDTAVYYCARTNYYYRSYMFYFDYWGQGTMVTVSS

SEQ ID NO: 1830 - protein, 123 aa, Artificial Sequence
  Description of Artificial Sequence: Synthetic polypeptide
  MOD_RES (62)..(62): Any amino acid
EVQLVQSGSELKKPGASVKVSCKASGYTFSNYGMYWVRQAPGQGLEWMGWINTETGEPTYAXGFTGRFVFSLDTSVSTAYLQISSLKAEDTAVYYCARTNYYYRSYMFYFDYWGQGTMVTVSS

SEQ ID NO: 1831 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARSNYYYTSYMFYFDYWGQGTMVTVSS

SEQ ID NO: 1832 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGQPTYADDFKGRFVFSLDTSVSTAYLQISSLKAEDTAVYYCARTNYYYRMYMFYFDYWGQGTMVTVSS

SEQ ID NO: 1833 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPYYADDFKGRFVFSLDTSVSTAYLQISSLKAEDTAVYYCARTNYYYPKYMFYFDYWGQGTMVTVSS

SEQ ID NO: 1834 - protein, 123 aa, Artificial Sequence
  Description of Artificial Sequence: Synthetic polypeptide
EVQLVQSGSELKKPGASVKVSCKASGYTFTHYWMYWVRQAPGQGLEWMGWINTETGKPAYADDFKGRFVFSLDTSVSTAYLQISSLKAEDTAVYYCARTNYYYIYYLFYFDYWGQGTMVTVSS

SEQ ID NO: 1835 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTGTGKPTYAQGFTGRFVFSLDTSVSTAYLQISSLKAEDTAVYYCARTNYYYRNYMFYFDYWGQGTMVTVSS

SEQ ID NO: 1836 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFTPYGMYWVRQAPGQGLEWMGWINTDTGXPPYADDFKGRFVFSLDTSVSTAYLQISSLKAEDTAVYYCARTNYYYTCYIFYFDYWGQGTMVTVSS

SEQ ID NO: 1837 - protein, 123 aa, Artificial Sequence
  Description of Artificial Sequence: Synthetic polypeptide
  MOD_RES (57)..(57): Any amino acid
EVQLVQSGSELKKPGASVKVSCKASGYTFTHYGMYWVRQAPGQGLEWMGWINTETGXPTYADDFKGRFVFSLDTSVSTAYLQISSLKAEDTAVYYCARTNYYYPRYMFYFDYWGQGTMVTVSS

SEQ ID NO: 1838 - protein, 123 aa, Artificial Sequence
  Description of Artificial Sequence: Synthetic polypeptide
  MOD_RES (59)..(59): Any amino acid
EVQLVQSGSELKKPGASVKVSCKASGYTFPDYGMYWVRQAPGQGLEWMGWIDTETGMPXYADDFKGRFVFSLDTSVSTAYLQISSLKAEDTAVYYCARTNYYYRNYMFYFDYWGQGTMVTVSS

SEQ ID NO: 1839 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1840 - protein, 123 aa, Artificial Sequence
  Description of Artificial Sequence: Synthetic polypeptide
  MOD_RES (99)..(99): Any amino acid
  MOD_RES (105)..(105): Any amino acid
EVQLVQSGSELKKPGASVKVSCKASGYTFTNYGMYWVRQAPGQGLEWMGWINTETGDPTYADDFKGRFVFSLDTSVSTAYLQISSLKAEDTAVYYCARXNYYYRXYMFYFDYWGQGTMVTVSS

SEQ ID NO: 1841 - protein, 123 aa, Artificial Sequence
  Description of Artificial Sequence: Synthetic polypeptide
EVQLVQSGSELKKPGASVKVSCKASGYTFNKYDMYWVRQAPGQGLEWMGWINTKTGKPTYAQGFTGRFVFSLDTSVSTAYLQISSLKAEDTAVYYCARTAYYYRNYKSTLITGGQGTMVTVSS

SEQ ID NO: 1842 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARTNYYYKGYMFYFDYWGQGTMVTVSS

SEQ ID NO: 1843 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGTPTYADDFKGRFVFSLDTSVSTAYLQISSLKAEDTAVYYCARTYYYYRTYIFYFDYWGQGTMVTVSS

SEQ ID NO: 1844 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFKGRFVFSLDTSVSTAYLQISSLKAEDTAVYYCARTNYYYRGYMFYFDYWGQGTMVTVSS

SEQ ID NO: 1845 - protein, 123 aa, Artificial Sequence
  Description of Artificial Sequence: Synthetic polypeptide
EVQLVQSGSELKKPGASVKVSCKASGYNFTKYEMYWVRQAPGQGLEWMGWINTETGNPTYADDFKGRFVFSLDTSVSTAYLQISSLKAEDTAVYYCARTKYYYRSYVFYFDYWGQGTMVTVSS

SEQ ID NO: 1846 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWIDTETGEPTYADDFKGRFVFSLDTSVSTAYLQISSLKAEDTAVYYCARTNYYYLSYMFYFDYWGQGTMVTVSS

SEQ ID NO: 1847 - protein, 123 aa, Artificial Sequence
  Description of Artificial Sequence: Synthetic polypeptide
EVQLVQSGSELKKPGASVKVSCKASGYTFTHYGMYWVRQAPGQGLEWMGWINTETGEPTYAQGFTGRFVFSLDTSVSTAYLQISSLKAEDTAVYYCARTNYYYPSYMFYFDYWGQGTMVTVSS

SEQ ID NO: 1848 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTDTGDPTYADDFKGRFVFSLDTSVSTAYLQISSLKAEDTAVYYCARANYYYRTYMFYFDYWGQGTMVTVSS

SEQ ID NO: 1849 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGTPTYADDFKGRFVFSLDTSVSTAYLQISSLKAEDTAVYYCARTNYYYPSYMFYFDYWGQGTMVTVSS

SEQ ID NO: 1850 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGDPTYADDFKGRFVFSLDTSVSTAYLQISSLKAEDTAVYYCARVNYYYRSYMFYFDYWGQGTMVTVSS

SEQ ID NO: 1851 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTQTGEPTYADDFKGRFVFSLDTSVSTAYLQISSLKAEDTAVYYCARSNYYYRLYMFYFDYWGQGTMVTVSS

SEQ ID NO: 1852 - protein, 123 aa, Artificial Sequence
  Description of Artificial Sequence: Synthetic polypeptide
EVQLVQSGSELKKPGASVKVSCKASGYTFPDYGMYWVRQAPGQGLEWMGWIDTETGQPTYADDFKGRFVFSLDTSVSTAYLQISSLKAEDTAVYYCARADYYYPTYMFYFDYWGQGTMVTVSS

SEQ ID NO: 1853 - protein, 123 aa, Artificial Sequence
  Description of Artificial Sequence: Synthetic polypeptide
EVQLVQSGSELKKPGASVKVSCKASGYTFTHYGMYWVRQAPGQGLEWMGWINTETGEPTYADDFKGRFVFSLDTSVSTAYLQISSLKAEDTAVYYCARTNYYYPTYMFYFDYWGQGTMVTVSS

SEQ ID NO: 1854 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARSNYYYRSYMFYFDYWGQGTMVTVSS

SEQ ID NO: 1855 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTVTGQPTYADDFKGRFVFSLDTSVSTAYLQISSLKAEDTAVYYCARTHYYYRTYLFYFDYWGQGTMVTVSS

SEQ ID NO: 1856 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1857 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARTNYYYRGYMFYFDYWGQGTMVTVSS

SEQ ID NO: 1858 - protein, 123 aa, Artificial Sequence
  Description of Artificial Sequence: Synthetic polypeptide
  MOD_RES (54)..(54): Any amino acid
EVQLVQSGSELKKPGASVKVSCKASGYTFTNYSMYWVRQAPGQGLEWMGWINTXTGKPIYAQGFTGRFVFSLDTSVSTAYLQISSLKAEDTAVYYCARTKYYYRTYRFYFDYWGQGTMVTVSS

SEQ ID NO: 1859 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGTPVYADDFKGRFVFSLDTSVNTAYLQISSLKAEDTAVYYCARTNYYYKSYMFYFDYWGQGTMVTVSS

SEQ ID NO: 1860 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFTGRFVFSLDTSVSTAYLQISSLKAEDTAVYYCARSNYYYSSYMFYFDYWGQGTMVTVSS

SEQ ID NO: 1861 - protein, 123 aa, Artificial Sequence
  Description of Artificial Sequence: Synthetic polypeptide
EVQLVQSGSELKKPGASVKVSCKASGYTFSEYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1862 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGKPTYADDFKGRFVFSLDTSVSTAYLQISSLKAEDTAVYYCARVNYYYRWYMFYFDYWGQGTMVTVSS

SEQ ID NO: 1863 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTETGEPTYAQGFTGRFVFSLDTSVSTAYLQISSLKAEDTAVYYCARTNYYYPSYMFYFDYWGQGTMVTVSS

SEQ ID NO: 1864 - protein, 123 aa, Artificial Sequence
  Description of Artificial Sequence: Synthetic polypeptide
EVQLVQSGSELKKPGASVKVSCKAYGYTFTDYGMYWVRQAPGQGLEWMGWINTETGEPTYAQGFTGRFVFSLDTSVSTAYLQISSLKAEDTAVYYCARTNYYYEKYMFYFDYWGQGTMVTVSS

SEQ ID NO: 1865 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARSNYYYRGYMFYFDYWGQGTMVTVSS

SEQ ID NO: 1866 - protein, 123 aa, Artificial Sequence
  Description of Artificial Sequence: Synthetic polypeptide
  MOD_RES (100)..(100): Any amino acid
  MOD_RES (104)..(104): Any amino acid
EVQLVQSGSELKKPGASVKVSCKASGYTFMTYVMYWVRQAPGQGLEWMGWINTETGKPSYAHDFTGRFVFSLDTSVSTAYLQISSLKAEDTAVYYCARMXYYYXIYMFYFDYWGQGTMVTVSS

SEQ ID NO: 1867 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1868 - protein, 123 aa, Artificial Sequence
  Description of Artificial Sequence: Synthetic polypeptide
  MOD_RES (27)..(27): Any amino acid
EVQLVQSGSELKKPGASVKVSCNASGXTFTNYGMYWVRQAPGQGLEWMGWINTETGKPTYAQGFTGRFVFSLDTSVSTAYLQISSLKAEDTAVYYCARINYYYRSYIFYFDYWGQGTMVTVSS

SEQ ID NO: 1869 - protein, 123 aa, Artificial Sequence
  Description of Artificial Sequence: Synthetic polypeptide
  MOD_RES (62)..(63): Any amino acid
EVQLVQSGSELKKPGASVKVSCKASGYTFNDYGMYWVRQAPGQGLEWMGWINTETGEPTYAXXFTGRFVFSLDTSVSTAYLQISSLKAEDTAVYYCARTNYYYEGYMFYFDYWGQGTMVTVSS

SEQ ID NO: 1870 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWINTETGEPTYADDFKGRFVFSLDTSVSTAYLQISSLKAEDTAVYYCARTNYYYRSYMFYFDYWGQGTMVTVSS

SEQ ID NO: 1871 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYAQGFTGRFVFSLDTSVSTAYLQISSLKAEDTAVYYCARTNYYYKSYMFYFDYWGQGTMVTVSS

SEQ ID NO: 1872 - protein, 123 aa, Artificial Sequence
  Description of Artificial Sequence: Synthetic polypeptide
EVQLVQSGSELRKPGASVKVSCKASGYTFNNYGMYWVRQAPGQGLEWMGWIDTETGRPWYADDFKGRFVFSLDTSVSTAYLQISSLKAEDTAVYYCARTNYYYQGYMFYFDYWGQGTMVTVSS

SEQ ID NO: 1873 - protein, 123 aa, Artificial Sequence
  Description of Artificial Sequence: Synthetic polypeptide
EVQLVQSGSELKKPGASVKVSCKASGYTFTNYGMHWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 1874 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSHIFYFDYWGQGTMVTVSS

SEQ ID NO: 1875 - protein, 123 aa, Artificial Sequence
  Description of Artificial Sequence: Synthetic polypeptide
EVQLVQSGSELKKPGASVRVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVSS

SEQ ID NO: 1876 - protein, 123 aa, Artificial Sequence
  Description of Artificial Sequence: Synthetic polypeptide
  MOD_RES (54)..(54): Any amino acid
  MOD_RES (62)..(62): Any amino acid
  MOD_RES (84)..(85): Any amino acid
  MOD_RES (87)..(87): Any amino acid
  MOD_RES (89)..(89): Any amino acid
  MOD_RES (99)..(99): Any amino acid
  MOD_RES (104)..(104): Any amino acid
EVQLVQSGSELKKPGASVKVSCKASGYTFTNYGMYWVRQAPGQGLEWMGWINTXTGKPTYAXGFTGRFVFSLDTSVSTAYLQIXXLXAXDTAVYYCARXKYYYXSYIFYFDYWGQGTMVTVSS

SEQ ID NO: 1877 - protein, 123 aa, Artificial Sequence
  Description of Artificial Sequence: Synthetic polypeptide
EVQLVQSGSELKKPGASVKVSCKASGYTFYNYCMYWVRQAPGQGLEWMGWINTETGIPKYAQGFTGRFVFSLDTSVSTAYLQISSLKAEDTAVYYCARINYYYKRYIFYFDYWGQGTMVTVSS

SEQ ID NO: 1878 - protein, 123 aa, Artificial Sequence
  Description of Artificial Sequence: Synthetic polypeptide
  MOD_RES (100)..(100): Any amino acid
  MOD_RES (104)..(104): Any amino acid
  MOD_RES (107)..(107): Any amino acid
EVQLVQSGSELKKPGASVKVSCKASGYTFTDYYMYWVRQAPGQGLEWMGWINTETGKPTYADDFKGRFVFSLDTSVSTAYLQISSLKAEDTAVYYCARTXYYYXRYXFYFDYWGQGTMVTVSS

SEQ ID NO: 1879 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLKAEDTAVYYCARTNYYYRSYIFYFDYWGQGTMVTVFS

SEQ ID NO: 1880 - protein, 123 aa, Artificial Sequence
  Description of Artificial Sequence: Synthetic polypeptide
  MOD_RES (88)..(88): Any amino acid
EVQLVQSGSELKKPGASVKVSCKASGYTFIHYGMYWVRQAPGQGLEWMGWINTETGRPTYADDFKGRFVFSLDTSVSTAYLQISSLKXEDTAVYYCARTVYYYPRYTFYFDYWGQGTMVTVSS

SEQ ID NO: 1881 - protein, 123 aa, Artificial Sequence
  Description of Artificial Sequence: Synthetic polypeptide
EVQLVQSGSELKKPGASVKVSCKASGYTFMNYGMYWVRQAPGQGLEWMGWINTETGKPTYAQGFTGRFVFSLDTSVSTAYLQISSLKAEDTAVYYCARTNYYYPGYIFYFDYWGQGTMVTVSS

SEQ ID NO: 1882 - protein, 123 aa, Artificial Sequence
  Description of Artificial Sequence: Synthetic polypeptide
  MOD_RES (104)..(104): Any amino acid
EVQLVQSGSELKKPGASVKVSCKASGYTFTLYGMYWVRQAPGQGLEWMGWINTDTGKPTYADDFKGRFVFSLDTSVSTAYLQISSLKAEDTAVYYCARTNYYYXSYIFYFDYWGQGTMVTVSS

SEQ ID NO: 1883 - protein, 123 aa, Artificial Sequence
  Description of Artificial Sequence: Synthetic polypeptide
EVQLVQSGSELKKPGASVKVSCKASGYTFNKYGMYWVRQAPGQGLEWMGWINTETGKPSYAQGFTGRFVFSLDTSVSTAYLQISSLKAEDTAVYYCARAKYYYRSYIFYFDYWGQGTMVTVSS

SEQ ID NO: 1884 - protein, 123 aa, Artificial Sequence
  Description of Artificial Sequence: Synthetic polypeptide
EVQLVQSGSELKKPGASVKVSCKASGYTFLNYGMYWVRQAPGQGLEWMGWINTETGRPTYAQGFTGRFVFSLDTSVSTAYLQISSLKAEDTAVYYCARTNYYYRIYRFYFDYWGQGTMVTVSS

SEQ ID NO: 1885 - protein, 123 aa, Artificial Sequence
  Description of Artificial Sequence: Synthetic polypeptide
  MOD_RES (99)..(99): Any amino acid
  MOD_RES (104)..(104): Any amino acid
  MOD_RES (106)..(107): Any amino acid
EVQLVQSGSELKKPGASVKVSCKASGYTFYNYGMYWVRQAPGQGLEWMGWINTATGKPTYAQGFTGRFVFSLDTSVSTAYLQISSLKAEDTAVYYCARXKYYYXSXXFYFDYWGQGTMVTVSS

SEQ ID NO: 1886 - protein, 123 aa, Artificial Sequence
  Description of Artificial Sequence: Synthetic polypeptide
EVQLVQSGSELKKPGASVKVSCKASGYTFSNYDMYWVRQAPGQGLEWMGWINTVTGLPTYAQGFTGRFVFSLDTSVSTAYLQISSLKAEDTAVYYCARTIYYYKSYIFYFDYWGQGTMVTVSS

SEQ ID NO: 1887 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTGTGIPTYAQGFTGRFVFSLDTSVSTAYLQISSLKAEDTAVYYCARTSYYYRNYLFYFDYWGQGTMVTVSS

SEQ ID NO: 1888 - protein, 123 aa, Artificial Sequence
  Description of Artificial Sequence: Synthetic polypeptide
EVQLVQSGSELKKPGASVKVSCKASGYTFTKYGMYWVRQAPGQGLEWMGWINTETGKPTYADDFKGRFVFSLDTSVSTAYLQISSLKAEDTAVYYCARTTYYYRRYIFYFDYWGQGTMVTVSS

SEQ ID NO: 1889 - protein, 123 aa, Artificial Sequence
  Description of Artificial Sequence: Synthetic polypeptide
EVQLVQSGSELKKPGASVKVSCKASGYTFTTYAMYWVRQAPGQGLEWMGWINTETGKPRYAQGFTGRFVFSLDTSVSTAYLQISSLKAEDTAVYYCARANYYYRSYIFYFDYWGQGTMVTVSS

SEQ ID NO: 1890 - protein, 123 aa, Artificial Sequence
  Description of Artificial Sequence: Synthetic polypeptide
  MOD_RES (84)..(85): Any amino acid
EVQLVQSGSELKKPGASVKVSCKASGYTFSNYGMYWVRQAPGQGLEWMGWINTETGKPTYADDFKGRFVFSLDTSVSTAYLQIXXLKTEDTAVYYCARSNYYYRGYIFYFDYWGQGTMVTVSS

SEQ ID NO: 1891 - protein, 123 aa, Artificial Sequence
  Description of Artificial Sequence: Synthetic polypeptide
EVQLVQSGSELKKPGASVKVSCKASGYTFAIYRMYWVRQAPGQGLEWMGWINTDTGKPTYADDFKGRFVFSLDTSVSTAYLQISSLKAEDTAVYYCARSKYYYGFYMFYFDYWGQGTMVTVSS

SEQ ID NO: 1892 - protein, 123 aa, Artificial Sequence
  Description of Artificial Sequence: Synthetic polypeptide
  MOD_RES (89)..(89): Any amino acid
EVQLVQSGSELKKPGASVKVSCKASGYTFMNYGMYWVRQAPGQGLEWMGWINTETGRPVYAQGFTGRFVFSLDTSVSTAYLQISSLKAXDTAVYYCARTNYYYLRYVFYFDYWGQGTMVTVSS

SEQ ID NO: 1893 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTGTGMPTYAQGFTGRFVFSLDTSVSTAYLQISSLKAEDTAVYYCARNKYYYRSYMFYFDYWGQGTMVTVSS

SEQ ID NO: 1894 - protein, 123 aa, Artificial Sequence
  Description of Artificial Sequence: Synthetic polypeptide
EVQLVQSGSELKKPGASVKVSCKASGYTFTNYDMYWVRQAPGQGLEWMGWINTETGKPPYADGFTGRFVFSLDTSVSTAYLQISSLKAEDTAVYYCARTNYYYRSYIFYFDYWGQGTMVTVSS

SEQ ID NO: 1895 - protein, 123 aa, Artificial Sequence
  Description of Artificial Sequence: Synthetic polypeptide
EVQLVQSGSELKKPGASVKVSCKASGYTFTSYGMYWVRQAPGQGLEWMGWINTETGIPTYADDFKGRFVFSLDTSVSTAYLQISSLKAEDTAVYYCARWDYYYTSYKFYFDYWGQGTMVTVSS

SEQ ID NO: 1896 - protein, 123 aa, Artificial Sequence
  Description of Artificial Sequence: Synthetic polypeptide
EVQLVQSGSELKKPGASVKVSCKASGYTFTIYGMYWVRQAPGQGLEWMGWINTVTGNPTYADDFKGRFVFSLDTSVSTAYLQISSLKAEDTAVYYCARTEYYYMNYIFYFDYWGQGTMVTVSS

SEQ ID NO: 1897 - protein, 123 aa, Artificial Sequence
  Description of Artificial Sequence: Synthetic polypeptide
EVQLVQSGSELKKPGASVKVSCKASGYTFTNYDMYWVRQAPGQGLEWMGWINTGTGKPTYADDFKGRFVFSLDTSVSTAYLQISSLKAEDTAVYYCARANYYYSRYDFYFDYWGQGTMVTVSS

SEQ ID NO: 1898 - protein, 123 aa, Artificial Sequence
  Description of Artificial Sequence: Synthetic polypeptide
EVQLVQSGSELKKPGASVKVSCKASGYTFTKYGMYWVRQAPGQGLEWMGWINTQTGKPAYAQGFTGRFVFSLDTSVSTAYLQISSLKAEDTAVYYCARAIYYYRIYIFYFDYWGQGTMVTVSS

SEQ ID NO: 1899 - protein, 123 aa, Artificial Sequence
  Description of Artificial Sequence: Synthetic polypeptide
  MOD_RES (67)..(67): Any amino acid
  MOD_RES (82)..(82): Any amino acid
  MOD_RES (87)..(87): Any amino acid
  MOD_RES (89)..(89): Any amino acid
  MOD_RES (99)..(99): Any amino acid
  MOD_RES (104)..(104): Any amino acid
  MOD_RES (115)..(115): Any amino acid
EVQLVQSGSELKKPGASVKVSCKASGYTFTNYAMYWVRQAPGQGLEWMGWINTQTGEPSYAQGFTGXFVFSLDTSASTEYLXISILXDXDTAVYYCARXTYYYXNYIFYFDYWGXGTMVTVSS

SEQ ID NO: 1900 - protein, 123 aa, Artificial Sequence
  Description of Artificial Sequence: Synthetic polypeptide
EVQLVQSGSELKKPGASVKVSCKASGYTFTTYGMYWVRQAPGQGLEWMGWINTETGRPTYADDFNGWFVFSLDTSVSTAYLQISSLKAEDTAVYYCARTNYYYRIYIFYFDYWGQGTMVTVSS

SEQ ID NO: 1901 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGKPTYADDFKGRFVFSLDTSVSTAYLQISSLKAEDTAVYYCARTNYYYRSYIFYFDYWGQGTMVTVSS

SEQ ID NO: 1902 - protein, 123 aa, Artificial Sequence
  Description of Artificial Sequence: Synthetic polypeptide
  MOD_RES (84)..(84): Any amino acid
EVQLVQSGSELKKPGASVKVSCKASGYTFNNYGMYWVRQAPGQGLEWMGWINTGTGKPTYAQGFTGRFVFSLDTSVSTAYLQIXSLKAEDTAVYYCARPIYYYIRYIFYFDYWGQGTMVTVSS

SEQ ID NO: 1903 - protein, 123 aa, Artificial Sequence
  Description of Artificial Sequence: Synthetic polypeptide
  MOD_RES (54)..(54): Any amino acid
EVQLVQSGSELKKPGASVKVSCKASGYTFADYPMYWVRQAPGQGLEWMGWINTXTGQPLYAQGFTGRFVFSLDTSVSTAYLQISSLKAEDTAVYYCARTSYYYRSYIFYFDYWGQGTMVTVSS

SEQ ID NO: 1904 - protein, 123 aa, Artificial Sequence
  Description of Artificial Sequence: Synthetic polypeptide
  MOD_RES (89)..(89): Any amino acid
EVQLVQSGSELKKPGASVKVSCKASGYTFTNYGMYWVRQAPGQGLEWMGWINTETGKPTYADDFKGRFVFSLDTSVSTAYLQISSLKAXDTAVYYCARTNYYYRSYIFYFDYWGQGTMVTVSS

SEQ ID NO: 1905 - protein, 123 aa, Artificial Sequence
  Description of Artificial Sequence: Synthetic polypeptide
EVQLVQSGSELKKPGASVKVSCKASGYTFTNYSMYWVRQAPGQGLEWMGWINTETGKPRYAQGFTGRFVFSLDTSVSTAYLQISSLKAEDTAVYYCARTSYYYRSYIFYFDYWGQGTMVTVSS

SEQ ID NO: 1906 - protein, 123 aa, Artificial Sequence
  Description of Artificial Sequence: Synthetic polypeptide
EVQLVQSGSELKKPGASVKVSCKASGYTFTTYWMYWVRQAPGQGLEWMGWINTETGEPRYAQGFTGRFVFSLDTSVSTAYLQISSLKAEDTAVYYCARTEYYYKSYNFYFDYWGQGTMVTVSS

SEQ ID NO: 1907 - protein, 123 aa, Artificial Sequence
  Description of Artificial Sequence: Synthetic polypeptide
EVQLVQSGSELKKPGASVKVSCKASGYTFTAYGMYWVRQAPGQGLEWMGWINTETGMPTYADDFKGRFVFSLDTSVSTAYLQISSLKAEDTAVYYCARTKYYYRSYMFYFDYWGQGTMVTVSS

SEQ ID NO: 1908 - protein, 123 aa, Artificial Sequence
  Description of Artificial Sequence: Synthetic polypeptide
EVQLVQSGSELKKPGASVKVSCKASGYTFHNYGMYWVRQAPGQGLEWMGWINTETGKPTYADDFKGRFVFSLDTSVSTAYLQISSLKAEDTAVYYCARTSYYYRSYFFYFDYWGQGTMVTVSS

SEQ ID NO: 1909 - protein, 123 aa, Artificial Sequence
  Description of Artificial Sequence: Synthetic polypeptide
  MOD_RES (104)..(104): Any amino acid
EVQLVQSGSELKKPGASVKVSCKASGYTFTNYVMYWVRQAPGQGLEWMGWINTETGNPTYADDFKGRFVFSLDTSVSTAYLQISSLKAEDTAVYYCARLIYYYXTYIFYFDYWGQGTMVTVSS

SEQ ID NO: 1910 - protein, 123 aa, Artificial Sequence
  Description of Artificial Sequence: Synthetic polypeptide
EVQLVQSGSELKKPGASVKVSCKASGYTFSNYAMYWVRQAPGQGLEWMGWINTETGKPPYADDFKGRFVFSLDTSVSTAYLQISSLKAEDTAVYYCARTLYYYRTYIFYFDYWGQGTMVTVSS

SEQ ID NO: 1911 - protein, 123 aa, Artificial Sequence
  Description of Artificial Sequence: Synthetic polypeptide
  MOD_RES (122)..(122): Any amino acid
EVQLVQSGSELKKPGASVKVSCKASGYTFTHYCMYWVRQAPGQGLEWMGWINTETGKPTYADDFKGRFVFSLDTSVSTAYLQISSLKAEDTAVYYCARTNYYYRRYIFYFDYWGQGTMVTVXS

SEQ ID NO: 1912 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGQPSYADDFKGRFVFSLDTSVSTAYLQISSLKAEDTAVYYCARTNYYYRCYIFYFDYWGQGTMVTVSS

SEQ ID NO: 1913 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPNYADDFKGRFVFSLDTSVSTAYLQISSLKAEDTAVYYCARPNYYYRSYIFYFDYWGQGTMVTVSS

SEQ ID NO: 1914 - protein, 123 aa, Artificial Sequence
  Description of Artificial Sequence: Synthetic polypeptide
EVQLVQSGSELKKPGASVKVSCKASGYTFTNYAMYWVRQAPGQGLEWMGWINTETGNPTYADDFKGRFVFSLDTSVSTAYLQISSLKAEDTAVYYCARTNYYYGIYLFYFDYWGQGTMVTVSS

SEQ ID NO: 1915 - protein, 123 aa, Artificial Sequence
  Description of Artificial Sequence: Synthetic polypeptide
EVQLVQSGSELKKPGASVKVSCKASGYTFTNYDMYWVRQAPGQGLEWMGWINTVTGRPAYADDFKGRFVFSLDTSVSTAYLQISSLKAEDTAVYYCARITYYYRMYRFYFDYWGQGTMVTVSS

SEQ ID NO: 1916 - protein, 123 aa, Artificial Sequence
  Description of Artificial Sequence: Synthetic polypeptide
EVQLVQSGSELKKPGASVKVSCKASGYTFIDYLMYWVRQAPGQGLEWMGWINTVTGKPTYAQGFTGRFVFSLDTSVSTAYLQISSLKAEDTAVYYCARTHYYYRSYAFYFDYWGQGTMVTVSS

SEQ ID NO: 1917 - protein, 123 aa, Artificial Sequence
  Description of Artificial Sequence: Synthetic polypeptide
EVQLVQSGSELKKPGASVKVSCKASGYTFAKYEMYWVRQAPGQGLEWMGWINTETGNPTYAQGFTGRFVFSLDTSVSTAYLQISSLKAEDTAVYYCARTNYYYRDYTFYFDYWGQGTMVTVSS

SEQ ID NO: 1918 - protein, 123 aa, Artificial Sequence
  Description of Artificial Sequence: Synthetic polypeptide
EVQLVQSGSELKKPGASVKVSCKASGYTFTTYRMYWVRQAPGQGLEWMGWINTVTGRPSYAQGFTGRFVFSLDTSVSTAYLQISSLKAEDTAVYYCARNIYYYRSYIFYFDYWGQGTMVTVSS

SEQ ID NO: 1919 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARTNYYYRSYIFYFDYWGQGTMVTVSS

SEQ ID NO: 1920 - protein, 123 aa, Artificial Sequence
  Description of Artificial Sequence: Synthetic polypeptide
EVQLVQSGSELKKPGASVKVSCKASGYTFRNYVMYWVRQAPGQGLEWMGWINTQTGEPSYAQGFTGRFVFSLDTSVSTAYLQISSLKAEDTAVYYCARTNYYYGIYIFYFDYWGQGTMVTVSS

SEQ ID NO: 1921 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGKPTYADDFKGRFVFSLDTSVSTAYLQISSLQAEDTAVYYCARTNYYYRSYIFYFDYWGQGTMVTVSS

SEQ ID NO: 1922 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGMPTYADDFKGRFVFSLDTSVSTAYLQISSLKAEDTAVYYCARSNYYYRGYIFYFDYWGQGTMVTVSS

SEQ ID NO: 1923 - protein, 123 aa, Artificial Sequence
  Description of Artificial Sequence: Synthetic polypeptide
EVQLVQSGSELKKPGASVKVSCKASGYTFLGYSMYWVRQAPGQGLEWMGWINTETGKPTYADDFKGRFVFSLDTSVSTAYLQISSLKAEDTAVYYCARKFYYYESYIFYFDYWGQGTMVTVSS

SEQ ID NO: 1924 - protein, 123 aa, Artificial Sequence
  Description of Artificial Sequence: Synthetic polypeptide
EVQLVQSGSELKKPGASVKVSCKASGYTFTYYCMYWVRQAPGQGLEWMGWINTHTGKPMYADDFKGRFVFSLDTSVSTAYLQISSLKAEDTAVYYCARKKYYYRSYIFYFDYWGQGTMVTVSS

SEQ ID NO: 1925 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGDPTYADDFKGRFVFSLDTSVSTAYLQISSLKAEDTAVYYCARTNYYYMSYMFYFDYWGQGTMVTVSS

SEQ ID NO: 1926 - protein, 123 aa, Artificial Sequence
  Description of Artificial Sequence: Synthetic polypeptide
EVQLVQSGSELKKPGASVKVSCKASGYTFMNYGMYWVRQAPGQGLEWMGWINTETGKPMYADDFKGRFVFSLDTSVSTAYLQISSLKAEDTAVYYCARTIYYYPRYIFYFDYWGQGTMVTVSS

SEQ ID NO: 1927 - protein, 123 aa, Artificial Sequence
  Description of Artificial Sequence: Synthetic polypeptide
EVQLVQSGSELKKPGASVKVSCKASGYTFAMYKMYWVRQAPGQGLEWMGWINTQTGGPSYAQGFTGRFVFSLDTSVSTAYLQISSLKAEDTAVYYCARTKYYYWRYVFYFDYWGQGTMVTVSS

SEQ ID NO: 1928 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGQPMYADDFKGRFVFSLDTSVSTAYLQISSLKAEDTAVYYCARTNYYYPSYMFYFDYWGQGTMVTVSS

SEQ ID NO: 1929 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGNPTYADDFKGRFVFSLDTSVSTAYLQISSLKAEDTAVYYCARSNYYYSSYMFYFDYWGQGTMVTVSS

SEQ ID NO: 1930 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTATGQPTYADDFKGRFVFSLDTSVSTAYLQISSLKAEDTAVYYCARANYYYMYYLFYFDYWGQGTMVTVSS

SEQ ID NO: 1931 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARANYYYRLYMFYFDYWGQGTMVTVSS

SEQ ID NO: 1932 - protein, 123 aa, Artificial Sequence
  Description of Artificial Sequence: Synthetic polypeptide
  MOD_RES (62)..(62): Any amino acid
EVQLVQSGSELKKPGASVKVSCKASGYTFPNYGMYWVRQAPGQGLEWMGWINTWTGKPTYAXDFTGRFVFSLDTSVSTAYLQISSLKAEDTAVYYCARTNYYYPSYMFYFDYWGQGTMVTVSS

SEQ ID NO: 1933 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARANYYYRTYMFYFDYWGQGTMVTVSS

SEQ ID NO: 1934 - protein, 123 aa, Artificial Sequence
  Description of Artificial Sequence: Synthetic polypeptide
EVQLVQSGSELKKPGASVKVSCKASGYTFTNYRMYWVRQAPGQGLEWMGWINTETGKPTYAQGFTGRFVFSLDTSVSTAYLQISSLKAEDTAVYYCARTNYYYSSYMFYFDYWGQGTMVTVSS

SEQ ID NO: 1935 - protein, 123 aa, Artificial Sequence
  Description of Artificial Sequence: Synthetic polypeptide
  MOD_RES (57)..(57): Any amino acid
  MOD_RES (62)..(63): Any amino acid
  MOD_RES (100)..(100): Any amino acid
EVQLVQSGSELKKPGASVKVSCKASGYTFTTYDMYWVRQAPGQGLEWMGWINTVTGXPTYAXXFTGRFVFSLDTSVSTAYLQISSLKAEDTAVYYCARSXYYYRSYIFYFDYWGQGTMVTVSS

SEQ ID NO: 1936 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTETGKPRYAQGFTGRFVFSLDTSVSTAYLQISSLKAEDTAVYYCARTDYYYRRYTFYFDYWGQGTMVTVSS

SEQ ID NO: 1937 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTYTGIPSYADDFKGRFVFSLDTSVSTAYLQISSLKAEDTAVYYCARVNYYYSTYIFYFDYWGQGTMVTVSS

SEQ ID NO: 1938 - protein, 123 aa, Artificial Sequence
  Description of Artificial Sequence: Synthetic polypeptide
EVQLVQSGSELKKPGASVKVSCKASGYTFTNYGIYWVRQAPGQGLEWMGWINTETGKPTYADDFKGRFVFSLDTSVSTAYLQISSLKAEDTAVYYCARSNYYYRGYMFYFDYWGQGTMVTVSS

SEQ ID NO: 1939 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCARSNYYYRSYMFYFDYWGQGTMVTVSS

SEQ ID NO: 1940 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTDTGEPTYADDFKGRFVFSLDTSVSTAYLQISSLKAEDTAVYYCARVNYYYRSYMFYFDYWGQGTMVTVSS

SEQ ID NO: 1941 - protein, 123 aa, Artificial Sequence
  Description of Artificial Sequence: Synthetic polypeptide
EVQLVQSGSELKKPGASVKVSCKASGYTFTTYGMYWVRQAPGQGLEWMGWINTLTGAPMYAQGFTGRFVFSLDTSVSTAYLQISSLKAEDTAVYYCARTNYYYSSYIFYFDYWGQGTMVTVSS

SEQ ID NO: 1942 - protein, 123 aa, Artificial Sequence
  Description of Artificial Sequence: Synthetic polypeptide
EVQLVQSGSELKKPGASVKVSCKASGYTFKNYSMYWVRQAPGQGLEWMGWINTDTGMPTYADDFKGRFVFSLDTSVSTAYLQISSLKAEDTAVYYCARTNYYYRFYIFYFDYWGQGTMVTVSS

SEQ ID NO: 1943 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFKGRFVFSLDTSVSTAYLQISSLKAEDTAVYYCARVNYYYRSYMFYFDYWGQGTMVTVSS

SEQ ID NO: 1944 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFTGRFVFSLDTSVSTAYLQISSLKAEDTAVYYCARANYYYRSYMFYFDYWGQGTMVTVSS

SEQ ID NO: 1945 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARTNYYYRGYMFYFDYWGQGTMVTVSS

SEQ ID NO: 1946 - protein, 123 aa, Artificial Sequence
  Description of Artificial Sequence: Synthetic polypeptide
EVQLVQSGSELKKPGASVKVSCKASGYTFANYGMYWVRQAPGQGLEWMGWINTETGQPTYADDFKGRFVFSLDTSVSTAYLQISSLKAEDTAVYYCARTNYYYQSYMFYFDYWGQGTMVTVSS

SEQ ID NO: 1947 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTDTGTPAYADDFKGRFVFSLDTSVSTAYLQISSLKAEDTAVYYCARTNYYYTRYNFYFDYWGQGTMVTVSS

SEQ ID NO: 1948 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYAQGFTGRFVFSLDTSVSTAYLQISSLKAEDTAVYYCARTNYYYRSYMFYFDYWGQGTMVTVSS

SEQ ID NO: 1949 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYAQGFTGRFVFSLDTSVSTAYLQISSLKAEDTAVYYCARANYYYRSYMFYFDYWGQGTMVTVSS

SEQ ID NO: 1950 - protein, 123 aa, Artificial Sequence
  Description of Artificial Sequence: Synthetic polypeptide
  MOD_RES (62)..(63): Any amino acid
  MOD_RES (99)..(99): Any amino acid
EVQLVQSGSELKKPGASVKVSCKASGYTFTNYDMYWVRQAPGQGLEWMGWINTETGNPTYAXXFTGRFVFSLDTSVSTAYLQISSLKAEDTAVYYCARXNYYYSSYIFYFDYWGQGTMVTVSS

SEQ ID NO: 1951 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARSNYYYRTYMFYFDYWGQGTMVTVSS

SEQ ID NO: 1952 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTETGKPTYADDFKGRFVFSLDTSVSTAYLQISSLKAEDTAVYYCARTNYYYPSYMFYFDYWGQGTMVTVSS

SEQ ID NO: 1953 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARTNYYYPSYMFYFDYWGQGTMVTVSS

SEQ ID NO: 1954 - protein, 123 aa, Artificial Sequence
  Description of Artificial Sequence: Synthetic polypeptide
EVQLVQSGSELKKPGASVKVSCKASGYTFTYYGMYWVRQAPGQGLEWMGWINTETGKPSYAQGFTGRFVFSLDTSVSTAYLQISSLKAEDTAVYYCARTIYYYTTYIFYFDYWGQGTMVTVSS

SEQ ID NO: 1955 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWIDTETGEPIYADDFKGRFVFSLDTSVSTAYLQISSLKAEDTAVYYCARINYYYPNYMFYFDYWGQGTMVTVSS

SEQ ID NO: 1956 - protein, 123 aa, Artificial Sequence
  Description of Artificial Sequence: Synthetic polypeptide
EVQLVQSGSELKKPGASVKVSCKTSGYTFTNYGMYWVRQAPGQGLEWMGWINTETGEPTYADDFKGRFVFSLDTSVSTAYLQISSLKAEDTAVYYCARTNYYYRGYMFYFDYWGQGTMVTVSS

SEQ ID NO: 1957 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYAQGFTGRFVFSLDTSVSTAYLQISSLKAEDTAVYYCARTNYYYPSYMFYFDYWGQGTMVTVSS

SEQ ID NO: 1958 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGNPTYADDFKGRFVFSLDTSVSTAYLQISSLKAEDTAVYYCARANYYYRSYMFYFDYWGQGTMVTVSS

SEQ ID NO: 1959 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGTPTYADDFKGRFVFSLDTSVSTAYLQISSLKAEDTAVYYCARTNYYYRSYMFYFDYWGQGTMVTVSS

SEQ ID NO: 1960 - protein, 123 aa, Artificial Sequence
  Description of Artificial Sequence: Synthetic polypeptide
EVQLVQSGSELKKPGASVKVSCKASGYTFSSYGMYWVRQAPGQGLEWMGWIDTETGEPKYADDFKGRFVFSLDTSVSTAYLQISSLKAEDTAVYYCARTNYYYPSYMFYFDYWGQGTMVTVSS

SEQ ID NO: 1961 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARYNYYYRIYLFYFDYWGQGTMVTVSS

SEQ ID NO: 1962 - protein, 123 aa, Artificial Sequence
  Description of Artificial Sequence: Synthetic polypeptide
EVQLVQSGSELKKPGASVKVSCKASGYTFPYYSMYWVRQAPGQGLEWMGWINTDTGTPTYAQGFTGRFVFSLDTSVSTAYLQISSLKAEDTAVYYCARTTYYYWSYIFYFDYWGQGTMVTVSS

SEQ ID NO: 1963 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGDPTYADDFKGRFVFSLDTSVSTAYLQISSLKAEDTAVYYCARTNYYYPSYMFYFDYWGQGTMVTVSS

SEQ ID NO: 1964 - protein, 123 aa, Artificial Sequence
  Description of Artificial Sequence: Synthetic polypeptide
  MOD_RES (54)..(54): Any amino acid
EVQLVQSGSELKKPGASVKVSCKASGYTFTNYGMYWVRQAPGQGLEWMGWINTXTGKPTYADDFKGRFVFSLDTSVSTAYLQISSLKAEDTAVYYCARTSYYYRCYIFYFDYWGQGTMVTVSS

SEQ ID NO: 1965 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGQPTYAQGFTGRFVFSLDTSVSTAYLQISSLKAEDTAVYYCARTNYYYRSYMFYFDYWGQGTMVTVSS

SEQ ID NO: 1966 - protein, 123 aa, Artificial Sequence
  Description of Artificial Sequence: Synthetic polypeptide
  MOD_RES (62)..(62): Any amino acid
EVQLVQSGSELKKPGASVKVSCKASGYTFSNYGMYWVRQAPGQGLEWMGWIDTDTGKPTYAXDFKGRFVFSLDTSVSTAYLQISSLKAEDTAVYYCARTNYYYTGYMFYFDYWGQGTMVTVSS

SEQ ID NO: 1967 - protein, 123 aa, Artificial Sequence
  Description of Artificial Sequence: Synthetic polypeptide
EVQLVQSGSELEKPGASVKVSCKASGYTFPNYGMYWVRQAPGQGLEWMGWIDTDTGKPTYADDFKGRFVFSLDTSVSTAYLQISSLKAEDTAVYYCARANYYYRSYMFYFDYWGQGTMVTVSS

SEQ ID NO: 1968 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWIDTETGDPTYAQGFTGRFVFSLDTSVSTAYLQISSLKAEDTAVYYCARANYYYLSYMFYFDYWGQGTMVTVSS

SEQ ID NO: 1969 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGEPTYADDFKGRFVFSLDTSVSTAYLQISSLKAEDTAVYYCARTNYYYRSYIFYFDYWGQGTMVTVSS

SEQ ID NO: 1970 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPSYAQGFTGRFVFSLDTSVSTAYLQISSLKAEDTAVYYCARTNYYYPSYMFYFDYWGQGTMVTVSS

SEQ ID NO: 1971 - protein, 123 aa, Artificial Sequence
  Description of Artificial Sequence: Synthetic polypeptide
EVQLVQSGSELKKPGASVKVSCKASGYTFANYGMYWVRQAPGQGLEWMGWIDTETGEPTYADDFKGRFVFSLDTSVSTAYLQISSLKAEDTAVYYCARTNYYYKSYMFYFDYWGQGTMVTVSS

SEQ ID NO: 1972 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTDTGEPTYADDFKGRFVFSLDTSVSTAYLQISSLKAEDTAVYYCARTNYYYRSYMFYFDYWGQGTMVTVSS

SEQ ID NO: 1973 - protein, 123 aa, Artificial Sequence
  Description of Artificial Sequence: Synthetic polypeptide
EVQLVQSGSELKKPGASVKVSCKASGYTFPYYGMYWVRQAPGQGLEWMGWINTETGEPTYADDFTGRFVFSLDTSVSTAYLQISSLKAEDTAVYYCARANYYYRMYMFYFDYWGQGTMVTVSS

SEQ ID NO: 1974 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGDPTYADDFKGRFVFSLDTSVSTAYLQISSLKAEDTAVYYCARTNYYYRGYMFYFDYWGQGTMVTVSS

SEQ ID NO: 1975 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGSPTYADDFKGRFVFSLDTSVSTAYLQISSLKAEDTAVYYCARIIYYYLSYLFYFDYWGQGTMVTVSS

SEQ ID NO: 1976 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWINTETGDPTYAQGFKGRFVFSLDTSVSTAYLQISSLKAEDTAVYYCARTNYYYPSYMFYFDYWGQGTMVTVSS

SEQ ID NO: 1977 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARANYYYSGYMFYFDYWGQGTMVTVSS

SEQ ID NO: 1978 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYAQGFTGRFVFSLDTSVSTAYLQISSLKAEDTAVYYCARTNYYYRYYMFYFDYWGQGTMVTVSS

SEQ ID NO: 1979 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYPSYMFYFDYWGQGTMVTVSS

SEQ ID NO: 1980 - protein, 123 aa, Artificial Sequence
  Description of Artificial Sequence: Synthetic polypeptide
EVQLVQSGSELKKPGASVKVSCKASGYTFTKYAMYWVRQAPGQGLEWMGWINTYTGVPTYADDFKGRFVFSLDTSVSTAYLQISSLKAEDTAVYYCARGHYYYMMYIFYFDYWGQGTMVTVSS

SEQ ID NO: 1981 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGKPTYADDFKGRFVFSLDTSVSTAYLQISSLKAEDTAVYYCARYKYYYRSYKFYFDYWGQGTMVTVSS

SEQ ID NO: 1982 - protein, 123 aa, Artificial Sequence
  Description of Artificial Sequence: Synthetic polypeptide
EVQLVQSGSELKKPGASVKVSCKASGYTFPDYGMYWVRQAPGQGLEWMGWINTETGEPTYADDFKGRFVFSLDTSVSTAYLQISSLKAEDTAVYYCARTNYYYRGYMFYFDYWGQGTMVTVSS

SEQ ID NO: 1983 - protein, 123 aa, Artificial Sequence
  Description of Artificial Sequence: Synthetic polypeptide
EVQLVQSGSELKKPGASVKVSCKASGYTFSHYGMYWVRQAPGQGLEWMGWINTETGDPTYADDFKGRFVFSLDTSVSTAYLQISSLKAEDTAVYYCARTNYYYPSYMFYFDYWGQGTMVTVSS

SEQ ID NO: 1984 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWINTETGEPTYAQGFTGRFVFSLDTSVSTAYLQISSLKAEDTAVYYCARTNYYYRSYMFYFDYWGQGTMVTVSS

SEQ ID NO: 1985 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGYPTYADDFKGRFVFSLDTSVSTAYLQISSLKAEDTAVYYCARANYYYRTYMFYFDYWGQGTMVTVSS

SEQ ID NO: 1986 - protein, 123 aa, Artificial Sequence
  Description of Artificial Sequence: Synthetic polypeptide
EVQLVQSGSELKKPGASVKVSCKASGYTFNNYGMYWVRQAPGQGLEWMGWINTETGEPTYADDFKGRFVFSLDTSVSTAYLQISSLKAEDTAVYYCARTNYYYRTYMFYFDYWGQGTMVTVSS

SEQ ID NO: 1987 - protein, 123 aa, Artificial Sequence
  Description of Artificial Sequence: Synthetic polypeptide
EVQLVQSGSELKKPGASVKVSCKASGYTFSHYGMYWVRQAPGQGLEWMGWINTETGEPTYAQGFTGRFVFSLDTSVSTAYLQISSLKAEDTAVYYCARANYYYRSYMFYFDYWGQGTMVTVSS

SEQ ID NO: 1988 - protein, 123 aa, Artificial Sequence
  Description of Artificial Sequence: Synthetic polypeptide
EVQLVQSGSELKKPGASVKVSCKASGYTFTSYRMYWVRQAPGQGLEWMRWINTETGWPTYAQGFTGRFVFSLDTSVSTAYLQISSLKAEDTAVYYCARTSYYYRNYMFYFDYWGQGTMVTVSS

SEQ ID NO: 1989 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGNPMYADDFKGRFVFSLDTSVSTAYLQISSLKAEDTAVYYCARTNYYYPSYMFYFDYWGQGTMVTVSS

SEQ ID NO: 1990 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWINTETGEPTYADDFKGRFVFSLDTSVSTAYLQISSLKAEDTAVYYCARTNYYYRNYMFYFDYWGQGTMVTVSS

SEQ ID NO: 1991 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWINTETGEPTYADDFKGRFVFSLDTSVSTAYLQISSLKAEDTAVYYCVRTNYYYRTYMFYFDYWGQGTMVTVSS

SEQ ID NO: 1992 - protein, 123 aa, Artificial Sequence
  Description of Artificial Sequence: Synthetic polypeptide
  MOD_RES (37)..(37): Any amino acid
EVQLVQSGSELKKPGASVKVSCKASGYTFTDYGMYWXRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 1993 - protein, 123 aa, Artificial Sequence
  Description of Artificial Sequence: Synthetic polypeptide
EVQLVQSGSELKKPGASVKVSCKASGYTFHDYGMYWVRQAPGQGLEWMGWIDTETGTPTYADDFKGRFVFSLDTSVSTAYLQISSLKAEDTAVYYCARTNYYYSSYMFYFDYWGQGTMVTVSS

SEQ ID NO: 1994 - protein, 123 aa, Artificial Sequence
  Description of Artificial Sequence: Synthetic polypeptide
  MOD_RES (57)..(57): Any amino acid
  MOD_RES (62)..(63): Any amino acid
EVQLVQSGSELKKPGASVKVSCKASGYTFTDYGMYWVRQAPGQGLEWMGWIDTETGXPTYAXXFTGRFVFSLDTSVSTAYLQISSLKAEDTAVYYCARTNYYYRSYMFYFDYWGQGTMVTVSS

SEQ ID NO: 1995 - protein, 123 aa, Artificial Sequence
  Description of Artificial Sequence: Synthetic polypeptide
EVQLVQSGSELKKPGASVKVSCKASGYTFNDYGMYWVRQAPGQGLEWMGWIDTETGKPTYADDFKGRFVFSLDTSVSTAYLQISSLKAEDTAVYYCARTNYYYSSYMFYFDYWGQGTMVTVSS

SEQ ID NO: 1996 - protein, 123 aa, Artificial Sequence
  Description of Artificial Sequence: Synthetic polypeptide
  MOD_RES (65)..(65): Any amino acid
EVQLVQSGSELKKPGASVKVSCKASGYTFTNYGMYWVRQAPGQGLEWMGWINTETGEPTYADDFXGRFVFSLDTSVSTAYLQISSLKAEDTAVYYCARTNYYYRSYMFYFDYWGQGTMVTVSS

SEQ ID NO: 1997 - protein, 123 aa, Artificial Sequence
  Description of Artificial Sequence: Synthetic polypeptide
  MOD_RES (99)..(99): Any amino acid
EVQLVQSGSELKKPGASVKVSCKASGYTFTDYGMYWVRQAPGQGLEWMGWIDTETGEPTYAHDFKGRFVFSLDTSVSTAYLQISSLKAEDTAVYYCARXNYYYRSYMFYFDYWGQGTMVTVSS

SEQ ID NO: 1998 - protein, 123 aa, Artificial Sequence
  Description of Artificial Sequence: Synthetic polypeptide
EVQLVQSGSELKKPGAPVKVSCKASGYTFTDYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 1999 - protein, 123 aa, Artificial Sequence
  Description of Artificial Sequence: Synthetic polypeptide
EVQLVQSGSELKKPGASVKVSCKASGYTFPDYGMYWVRQAPGQGLEWMGWIDTETGQPTYADDFKGRFVFSLDTSVSTAYLQISSLKAEDTAVYYCARTNYYYRTYMFYFDYWGQGTMVTVSS

SEQ ID NO: 2000 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPIYAQGFKGRFVFSLDTSVSTAYLQISSLKAEDTAVYYCARTNYYYNSYMFYFDYWGQGTMVTVSS

SEQ ID NO: 2001 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPRYAQGFTGRFVFSLDTSVSTAYLQISSLKAEDTAVYYCARTNYYYPSYMFYFDYWGQGTMVTVSS

SEQ ID NO: 2002 - protein, 123 aa, Artificial Sequence
  Description of Artificial Sequence: Synthetic polypeptide
EVQLVQSGSELKKPGASVKVSCKASGYTFPHYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2003 - protein, 123 aa, Artificial Sequence
  Description of Artificial Sequence: Synthetic polypeptide
EVQLVQSGSELKKPGASVKVSCKASGYTFEDYGMYWVRQAPGQGLEWMGWINTETGEPTYAQGFTGRFVFSLDTSVSTAYLQISSLKAEDTAVYYCARTNYYYRNYMFYFDYWGQGTMVTVSS

SEQ ID NO: 2004 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYAQGFTGRFVFSLDTSVSTAYLQISSLKAEDTAVYYCARTNYYYRTYMFYFDYWGQGTMVTVSS

SEQ ID NO: 2005 - protein, 123 aa, Artificial Sequence
  Description of Artificial Sequence: Synthetic polypeptide
EVQLVQSGSELKKPGASVKVSCKASGYTFDDYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2006 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGTPTYAQGFTGRFVFSLDTSVSTAYLQISSLKAEDTAVYYCARTNYYYRSYMFYFDYWGQGTMVTVSS

SEQ ID NO: 2007 - protein, 123 aa, Artificial Sequence
  Description of Artificial Sequence: Synthetic polypeptide
EVQLVQSGSELKKPGASVKVSCKASGYTFGDYGMYWVRQAPGQGLEWMGWIDTETGEPTYAQGFTGRFVFSLDTSVSTAYLQISSLKAEDTAVYYCARVNYYYRNYMFYFDYWGQGTMVTVSS

SEQ ID NO: 2008 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGQPTYADDFKGRFVFSLDTSVSTAYLQISSLKAEDTAVYYCARTNYYYKSYMFYFDYWGQGTMVTVSS

SEQ ID NO: 2009 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYRGYMFYFDYWGQGTMVTVSS

SEQ ID NO: 2010 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGDPTYADDFKGRFVFSLDTSVSTAYLQISSLKAEDTAVYYCARTNYYYRSYMFYFDYWGQGTMVTVSS

SEQ ID NO: 2011 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2012 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGTPTYAQGFTGRFVFSLDTSVSTAYLQISSLKAEDTAVYYCARTNYYYKSYMFYFDYWGQGTMVTVSS

SEQ ID NO: 2013 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGQPTYADDFKGRFVFSLDTSVSTAYLQISSLKAEDTAVYYCARTNYYYPSYMFYFDYWGQGTMVTVSS

SEQ ID NO: 2014 - protein, 123 aa, Artificial Sequence
  Description of Artificial Sequence: Synthetic polypeptide
EVQLVQSGSELKKPGASVKVSCKASGYTFSHYGMYWVRQAPGQGLEWMGWIDTETGEPTYADDFKGRFVFSLDTSVSTAYLQISSLKAEDTAVYYCARTNYYYMSYMFYFDYWGQGTMVTVSS

SEQ ID NO: 2015 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTDTGTPTYADDFKGRFVFSLDTSVSTAYLQISSLKAEDTAVYYCARTNYYYPKYMFYFDYWGQGTMVTVSS

SEQ ID NO: 2016 - protein, 123 aa, Artificial Sequence
  Description of Artificial Sequence: Synthetic polypeptide
EVQLVQSGSELKKPGASVKVSCKASGYTFANYGMYWVRQAPGQGLEWMGWIDTETGTPTYADDFKGRFVFSLDTSVSTAYLQISSLKAEDTAVYYCARTNYYYRSYMFYFDYWGQGTMVTVSS

SEQ ID NO: 2017 - protein, 123 aa, Artificial Sequence
  Description of Artificial Sequence: Synthetic polypeptide
EVHLVQSGSELKKPGASVKVSCKASGYTFSNYGMYWVRQAPGQGLEWMGWIDTETGKPTYADDFKGRFVFSLDTSVSTAYLQISSLKAEDTAVYYCARTNYYYRSYMFYFDYWGQGTMVTVSS

SEQ ID NO: 2018 - protein, 123 aa, Artificial Sequence
  Description of Artificial Sequence: Synthetic polypeptide
  MOD_RES (75)..(75): Any amino acid
  MOD_RES (81)..(81): Any amino acid
  MOD_RES (91)..(91): Any amino acid
  MOD_RES (95)..(95): Any amino acid
  MOD_RES (118)..(118): Any amino acid
EVQLVQSGSELNKPGASVKVSCKASGYTFTNYGMYWVRQAPGQGLEWMGWIDTETGEPSYADDFKGRFVFSLDTXVSTAYXQISSLKAEDXAVYXCARTNYYYSSYMFYFDYWGQGTXVTVSS

SEQ ID NO: 2019 - protein, 123 aa, Artificial Sequence
  Description of Artificial Sequence: Synthetic polypeptide
EVQLVQSGSELKKPGASVKVSCKASGYTFNDYGMYWVRQAPGQGLEWMGWIDTETGNPTYADDFKGRFVFSLDTSVSTAYLQISSLKAEDTAVYYCARANYYYRSYMFYFDYWGQGTMVTVSS

SEQ ID NO: 2020 - protein, 123 aa, Artificial Sequence
  Description of Artificial Sequence: Synthetic polypeptide
  MOD_RES (18)..(18): Any amino acid
  MOD_RES (67)..(67): Any amino acid
  MOD_RES (77)..(78): Any amino acid
EVQLVPSGSHFNNPGASXKVSCSASGYTFSDYGMYWVRQAPGQGLEWMGWIDTETGDPTYADDFKGXFVFSLDTSVXXAYLQISSLKAEDTAVYYCARTNYYYRSYMFYFDYWGQGTMVTVSS

SEQ ID NO: 2021 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGDPTYADDFKGRFVFSLDTSVSTAYLQISSLKAEDTAVYYCARTNYYYPSYMFYFDYWGQGTMVTVSS

SEQ ID NO: 2022 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGKPTYADDFTGRFVFSLDTSVSTAYLQISSLKAEDTAVYYCARTNYYYRTYMFYFDYWGQGTMVTVSS

SEQ ID NO: 2023 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGQPTYAQGFTGRFVFSLDTSVSTAYLQISSLKAEDTAVYYCARTNYYYRSYMFYFDYWGQGTMVTVSS

SEQ ID NO: 2024 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGTPTYADDFKGRFVFSLDTSVSTAYLQISSLKAEDTAVYYCARTNYYYESYMFYFDYWGQGTMVTVSS

SEQ ID NO: 2025 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARTNYYYPSYMFYFDYWGQGTMVTVSS

SEQ ID NO: 2026 - protein, 123 aa, Artificial Sequence
  Description of Artificial Sequence: Synthetic polypeptide
  MOD_RES (62)..(63): Any amino acid
EVQLVQSGSELKKPGASVKVSCKASGYTFTDYGMYWVRQAPGQGLEWMGWIDTETGEPTYAXXFTGRFVFSLDTSVSTAYLQISSLKAEDTAVYYCARTNYYYRSYMFYFDYWGQGTMVTVSS

SEQ ID NO: 2027 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGKPTYADDFKGRFVFSLDTSVSTAYLQISSLKAEDTAVYYCARTNYYYRSYMFYFDYWGQGTMVTVSS

SEQ ID NO: 2028 - protein, 123 aa, Artificial Sequence
  Description of Artificial Sequence: Synthetic polypeptide
EVQLVQSGSELKKPGASVKVSCKASGYTFNDYGMYWVRQAPGQGLEWMGWIDTETGTPTYADDFKGRFVFSLDTSVSTAYLQISSLKAEDTAVYYCARTNYYYSSYMFYFDYWGQGTMVTVSS

SEQ ID NO: 2029 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYRTYMFYFDYWGQGTMVTVSS

SEQ ID NO: 2030 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYRNYMFYFDYWGQGTMVTVSS

SEQ ID NO: 2031 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYAQGFTGRFVFSLDTSVSTAYLQISSLKAEDTAVYYCARTNYYYRSYMFYFDYWGQGTMVTVSS

SEQ ID NO: 2032 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGEPTYAQGFTGRFVFSLDTSVSTAYLQISSLKAEDTAVYYCARTNYYYPSYMFYFDYWGQGTMVTVSS

SEQ ID NO: 2033 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISNLKAEDTAVYYCARTNYYYRSYMFYFDYWGQGTMVTVSS

SEQ ID NO: 2034 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYPRYMFYFDYWGQGTMVTVSS

SEQ ID NO: 2035 - protein, 123 aa, Artificial Sequence
  Description of Artificial Sequence: Synthetic polypeptide
  MOD_RES (23)..(23): Any amino acid
EVQLVQSGSELKKPGASVKVSCXASGYTFSDYGMYWVRQAPGQGLEWMGWIDTETGDPTYADDFKGRFVFSLDTSVSTAYLQISSLKAEDTAVYYCARANYYYRSYMFYFDYWGQGTMVTVSS

SEQ ID NO: 2036 - protein, 123 aa, Artificial Sequence
  Description of Artificial Sequence: Synthetic polypeptide
RVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2037 - protein, 123 aa, Artificial Sequence
  Description of Artificial Sequence: Synthetic polypeptide
EVQLVQSGSELKKPGASVKVSCEASGYTFSDYGMYWVRQAPGQGLEWMGWIDTETGDPTYADDFKGRFVFSLDTSVSTAYLQISSLKAEDTAVYYCARANYYYRSYMFYFDYWGQGTMVTVSS

SEQ ID NO: 2038 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYAQGFTGRFVFSLDTSVSTAYLQISSLKAEDTAVYYCARTNYYYPSYMFYFDYWGQGTMVTSLQ

SEQ ID NO: 2039 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKVEDTAVYYCARTNYYYRSYMFYFDYWGQGTMVTVSS

SEQ ID NO: 2040 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGTPTYADDFKGRFVFSLDTSVSTAYLQISSLKAEDTAVYYCARTNYYYSSYMFYFDYWGQGTMVTVSS

SEQ ID NO: 2041 - protein, 123 aa, Artificial Sequence
  Description of Artificial Sequence: Synthetic polypeptide
ASAAVQSGSELKKPGASVKVSCKASGYTFENYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2042 - protein, 123 aa, Artificial Sequence
  Description of Artificial Sequence: Synthetic polypeptide
EVQLVQSGSELKKPGASVKVSCKASGYTFENYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2043 - protein, 123 aa, Artificial Sequence
  Description of Artificial Sequence: Synthetic polypeptide
EVQLVQSGSELKKPGASVKVSCKASGYTFENYGMYWVRQAPGQGLEWMGWIDTETGEPTYADDFKGRFVFSLGTSVSTAYLQISSLKAEDTAVYYCARTNYYYSSYMFYFDYWGQGTMVTVSS

SEQ ID NO: 2044 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2045 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGDPTYADDFKGRFVFSLDTSVSTAYLQISSLKAEDTAVYYCARANYYYRSYMFYFDYWGQGTMVTVSS

SEQ ID NO: 2046 - protein, 123 aa, Artificial Sequence
  Description of Artificial Sequence: Synthetic polypeptide
EVQLVQSGSELKKPGASVKVSCKASGYTFDDYGMYWVRQAPGQGLEWMGWIDTETGTPTYADDFKGRFVFSLDTSVSTAYLQISSLKAEDTAVYYCARTNYYYSSYMFYFDYWGQGTMVTVSS

SEQ ID NO: 2047 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYAQGFTGRFVFSLDTSVSTAYLQISSLKAEDTAVYYCARTNYYYPSYMFYFDYWGQGTMVTVSS

SEQ ID NO: 2048 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2049 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2050 - protein, 123 aa, Artificial Sequence
  Description of Artificial Sequence: Synthetic polypeptide
  MOD_RES (36)..(36): Any amino acid
EVQLVQSGSELKKPGASVKVSCKASGYTFTHYGMYXVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2051 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGDPTYADDFKGRFVFSLDTSVSTAYLQISSLKAEDTAVYYCARTNYYYPSYMFYFDYWGQGTMVTVSS

SEQ ID NO: 2052 - protein, 123 aa, Artificial Sequence
  Description of Artificial Sequence: Synthetic polypeptide
EVQLVQSGSELKKPGASVKVSCKASGYTFTDYGMYWVRQAPGQGPEWMGWIDTETGNPTYADDFKGRFVFSLDTSVSTAYLQISSLKAEDTAVYYCARTNYYYPSYMFYFDYWGQGTMVTVSS

SEQ ID NO: 2053 - protein, 123 aa, Artificial Sequence
  Description of Artificial Sequence: Synthetic polypeptide
EVQLVQSGSELKKPGASVKVSCKASGYTFTHYGMYWVRQAPGQGLEWMGWIDTETGEPTYADDFKGRFVFSLDTSVSTAYLQISSLKAENTAVYYCARTNYYYRSYMFYFDYWGQGTMVTVSS

SEQ ID NO: 2054 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYAQGFTGRFVFSLDTSVSTAYLQISSLKAEDTAVYYCARTNYYYRSYMFYFDYWGQGTMVTVSS

SEQ ID NO: 2055 - protein, 123 aa, Artificial Sequence
  Description of Artificial Sequence: Synthetic polypeptide
  MOD_RES (10)..(10): Any amino acid
  MOD_RES (13)..(13): Any amino acid
  MOD_RES (16)..(16): Any amino acid
  MOD_RES (18)..(18): Any amino acid
  MOD_RES (23)..(23): Any amino acid
  MOD_RES (46)..(46): Any amino acid
  MOD_RES (53)..(54): Any amino acid
  MOD_RES (84)..(84): Any amino acid
  MOD_RES (88)..(88): Any amino acid
  MOD_RES (118)..(119): Any amino acid
EVQLVQSGSXLKXPGXSXKVSCXVSGYTFQNYGMYCVRPAPGQWLXWMGWIDXXTGEPTYAYDFKGWFLFSLHTSVSMSSLQNXSLKXDDTAVYYCAKTNYYYNSYMFYFDYWGQGTXXTVSS

SEQ ID NO: 2056 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGQPTYADDFKGRFVFSLDTSVSTAYLQISSLKAEDTAVYYCARTNYYYRNYMFYFDYWGQGTMVTVSS

SEQ ID NO: 2057 - protein, 123 aa, Artificial Sequence; identical to SEQ ID NO: 43
  Description of Artificial Sequence: Synthetic polypeptide

SEQ ID NO: 2058 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYAQGFTGRFVFSLDTSVSTAYLQISSLKAEDTAVHYCARTNYYYRSYMFYFDYWGQGTMVTVSS

SEQ ID NO: 2059 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2060 - protein, 123 aa, Artificial Sequence
  Description of Artificial Sequence: Synthetic polypeptide
EVQLVQSGSELKKPGASVKVSCKASGYTFTHYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2061 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGNPTYADDFKGRFVFSLDTSVSTAYLQISSLKAEDTAVYYCARTNYYYPSYMFYFDYWGQGTMVTVSS

SEQ ID NO: 2062 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGQPTYADDFKGRFVFSLDTSVSTAYLQISSLKAEDTAVYYCARTNYYYRSYMFYFDYWGQGTMVTVSS

SEQ ID NO: 2063 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEGTAVYYCARTNYYYSSYMFCFDYWGQGTMVTVSS

SEQ ID NO: 2064 - protein, 123 aa, Artificial Sequence
  Description of Artificial Sequence: Synthetic polypeptide
EVQLVQSGSELKKPGASVKVSCKASGYTFSNYGMYWVRQAPGQGLEWMGWIDTETGEPTYADDFKGRFVFSLDTSVSTAYLQISSLKAEDTAVYYCARTNYYYSSYMFYFDYWGQGAMVTVSS

SEQ ID NO: 2065 - protein, 123 aa, Artificial Sequence
  Description of Artificial Sequence: Synthetic polypeptide
EVQLVQSGSELKKPGASVKVSCKASGYTFTHYGMYWVRRAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2066 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGEPTYADDFKGRFVFSLDTSVSTAYLQISSLKVEDTAVYYCARTNYYYRSYMFYFDYWGQGTMVTVSS

SEQ ID NO: 2067 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYPSYMFYFDYWGQGTMVTVSS

SEQ ID NO: 2068 - protein, 123 aa, Artificial Sequence
  Description of Artificial Sequence: Synthetic polypeptide
EVQLVQSGSELEKPGASVKVSCKASGYTFTDYGMYWVRQAPGQGLEWMGWIDTETGEPTYADDFKGRFVFSLDTSVSTAYLQISSLKAEDTAVYYCARTNYYYRGYMFYFDYWGQGTMVTSLQ

SEQ ID NO: 2069 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDAETGEPTYADDFKGRFVFSLDTSVSTAYLQISSLKAEDTAVYYCARTNYYYRGYMFYFDYWGQGTMVTVSS

SEQ ID NO: 2070 - protein, 123 aa, Artificial Sequence
  Description of Artificial Sequence: Synthetic polypeptide
  MOD_RES (23)..(23): Any amino acid
  MOD_RES (30)..(30): Any amino acid
  MOD_RES (62)..(62): Any amino acid
  MOD_RES (84)..(84): Any amino acid
  MOD_RES (98)..(98): Any amino acid
  MOD_RES (111)..(111): Any amino acid
EGHLGQSGSELKNPGASVKVSCXASGYTFXNYGMYWVRQAPGQGLEWMGWIDTETGEPTYAXDFKGRFVFSLGTSVSTAYLQIXSLRAEDTAVYYCEXTNYYYSRYMFYFXYWGQGTMVTVSS

SEQ ID NO: 2071 - protein, 123 aa, Artificial Sequence
  Description of Artificial Sequence: Synthetic polypeptide
  MOD_RES (50)..(50): Any amino acid
EVQLVQSGSELKKPGASVKVSCKASGYTFTNYGMYWVRQAPGQGLEWMGXIDTETGEPTYADDFKGRFVFSLDTSVSTAYLQISSLKAEDTAVYYCARTNYYYKSYMFYFDYWGQGTMVTVSS

SEQ ID NO: 2072 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGEPTYADDFKGRFVFSLDTSVSTAYLQISSLKAEDTAVYYCARTNYYYRSYMFYFDYWGQGTMVTVFS

SEQ ID NO: 2073 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYRGYMLYFDYWGQGTMVTVSS

SEQ ID NO: 2074 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWIDTETGEPTYADDFKGRFVFSLDTSVSTAYLQISSLKAEDTAVYYCARTNYYYKSYMFYFDYWGQGTMVTVSS

SEQ ID NO: 2075 - protein, 123 aa, Artificial Sequence
  Description of Artificial Sequence: Synthetic polypeptide
EVQLVQSGSELKKPGASVKVSCKASGYTFTDYGMYWVRRAPGQGLEWMGWIDTETGEPTYADDFKGRFVFSLDTSVSTAYLQISSLKAEDTAVYYCARTNYYYRGYMFYFDYWGQGTMVTVSS

SEQ ID NO: 2076 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRLVFSLDTSVSTAYLQISSLKAEDTAVYYCARTNYYYKSYMFYFDYWGQGTMVTVSS

SEQ ID NO: 2077 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYSSYMFYFDYWGQGTMVTVSS

SEQ ID NO: 2078 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYRGYMFYFDYWGQGTMVTVSS

SEQ ID NO: 2079 - protein, 123 aa, Artificial Sequence
  Description of Artificial Sequence: Synthetic polypeptide
EVQLVQSGSELKKPGASVKVSCKASGYTFPNYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2080 - protein, 123 aa, Artificial Sequence
  Description of Artificial Sequence: Synthetic polypeptide
  MOD_RES (104)..(104): Any amino acid
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYXSYMFYFDYWGQGTMVTVSS

SEQ ID NO: 2081 - protein, 123 aa, Artificial Sequence
  Description of Artificial Sequence: Synthetic polypeptide
EVQLVQSGSELKKPGASVKVSCKASGYTFTNYGMYWVRQAPGQGLEWMGWIDTETGEPTYADDFKGRFVFSLDTSVSTAYLQISSLKAEDTAVYYCARTNYYYKSYMFYFDYWGQGTMVTVSS

SEQ ID NO: 2082 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGQFVFSLDTSVSTAYLQISSLKAEDTAVYYCARTNYYYPSYMFYFDYWGQGTMVTVSS

SEQ ID NO: 2083 - protein, 123 aa, Artificial Sequence
  Description of Artificial Sequence: Synthetic polypeptide
EVQLVQSGSELKKPGASVKVSCKASGYTFTDYGMYWVRQAPGQGLEWMGWIDTETGEPTYADDFKGRFVFSLDTSVSTAYLQISSLKAEDTAVYYCARTNYYYPSHMFYFDYWGQGTMVTVSS

SEQ ID NO: 2084 - protein, 123 aa, Artificial Sequence
  Description of Artificial Sequence: Synthetic polypeptide
EVQLVQSGSELKKPGASVKVSCKASGYTFSDYGMYWVRQAPGQGLEWMGWIDTETGEPTYADDFKGRFVFSLDTSVSTAYLQISSLKAEDTAVYYCARTNYYYRSYMFYFDYWGQGTMVTVSS

SEQ ID NO: 2085 - protein, 107 aa, Artificial Sequence
  Description of Artificial Sequence: Synthetic polypeptide
  MOD_RES (42)..(42): Any amino acid
EIVLTQSPATLSLSPGERATLSCRASESVSTHMHWYQQKPGXAPRLLIYGASNLESGVPARFSGSGSGTDFTLTISSLEPEDFAVYFCQQSWNDPFTFGQGTKLEIK

SEQ ID NO: 2086 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSRSGTDFTLTISSLEPEDFAVYFCQQSWNDPFTFGQGTKLEIK

SEQ ID NO: 2087 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGAKLEIK

SEQ ID NO: 2088 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWNDPFTFGLGTKLEIK

SEQ ID NO: 2089 - protein, 107 aa, Artificial Sequence
  Description of Artificial Sequence: Synthetic polypeptide
EIVLTQFPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK

SEQ ID NO: 2090 - protein, 107 aa, Artificial Sequence
  Description of Artificial Sequence: Synthetic polypeptide
EIVLTQSPATLSLSPGERATLSCRASQSVTPHMHWYQQKPGQAPRLLIYGASTLESGIPARFSGSGSGTDFTLTISSLEPEDFAVYYCQQSCNDPFTFGQGTKLEIK

SEQ ID NO: 2091 - protein, 107 aa, Artificial Sequence
  Description of Artificial Sequence: Synthetic polypeptide
EIVLTQSPATLSLSPGERATLSGRASESVDKYMHWYQQKPGQAPRLLIYGASNLESGVPARFSGSGSGTDFTLTISSLEPEDFAVYFCQQSRNDPLTFGQGTKLEIK

SEQ ID NO: 2092 - protein, 107 aa, Artificial Sequence
  Description of Artificial Sequence: Synthetic polypeptide
EIVLTQSPATLSLSPGERATLSCRASQSVKTDMHWYQQKPGQAPRLLIYGASNLESGVPARFSGSGSGTDFTLTISSLEPEDFAVYYCQQSRNEPFTFGQGTKLEIK

SEQ ID NO: 2093 - protein, 107 aa, Artificial Sequence
  Description of Artificial Sequence: Synthetic polypeptide
EIVLTQSPATLSLSPGERATLSCRASQSVSTHLAWYQQKPGQAPRLLIYRASKLESGVPARFSGSGSGTDFTLTISSLEPEDFAVYYCQQNWNDPLTFGQGTKLEIK

SEQ ID NO: 2094 - protein, 107 aa, Artificial Sequence
  Description of Artificial Sequence: Synthetic polypeptide
  MOD_RES (94)..(94): Any amino acid
EIVLTQSPATLSLSPGERATLSCRASQSVRTHMHWYQQKPGQAPRLLIYGASALESGIPARFSGSGSGTDFTLTISSLEPEDFAVYYCQQGCNXPFTFGQGTKLEIK

SEQ ID NO: 2095 - protein, 107 aa, Artificial Sequence
  Description of Artificial Sequence: Synthetic polypeptide
EIVLTQSPATLSLSPGERATLSCRASQSVRTHMHWYQQKPGQAPRLLIYEASNLESGIPARFSGSGSGTDFTLTISSLEPEDFAVYFCQQSCNDPFTFGQGTKLEIK

SEQ ID NO: 2096 - protein, 107 aa, Artificial Sequence
  Description of Artificial Sequence: Synthetic polypeptide
EIVLTQSPATLSLSPGERATLSCRASQSVSTDMHWYQQKPGQAPRLLIYGASKLESGIPARFSGSGSGTDFTLTISSLEPEDFAVYFCQQSWNDPFTFGQGTKLEIK

SEQ ID NO: 2097 - protein, 107 aa, Artificial Sequence
  Description of Artificial Sequence: Synthetic polypeptide
EIVLTQSPATLSLSPGERATLSCRASQSVSPHMHWYQQKPGQAPRLLIYGASKLESGVPARFSGSGSGTDFTLTISSLEPEDFAVYYCQQTSNEPFTFGQGTKLEIK

SEQ ID NO: 2098 - protein, 107 aa, Artificial Sequence
  Description of Artificial Sequence: Synthetic polypeptide
  MOD_RES (92)..(92): Any amino acid
EIVLTQSPATLSLSPGERATLSCRASQSVSTHMHWYQQKPGQAPRLLIYGASDLESGIPARFSGSGSGTDFTLTISSLEPEDFAVYFCQQSXIDPVTFGQGTKLEIK

SEQ ID NO: 2099 - protein, 107 aa, Artificial Sequence
  Description of Artificial Sequence: Synthetic polypeptide
EIVLTQSPATPSLSPGERATLSCRASESVNAHMHWYQQKPGQAPRLLIYDASKLESGVPARFSGSGSGTDFTLTISSLEPEDFAVYYCQQSWSDPFTFGQGTKLEIK

SEQ ID NO: 2100 - protein, 107 aa, Artificial Sequence
  Description of Artificial Sequence: Synthetic polypeptide
EIVLTQSPATLSLSPGERATLSCRASESVRTQLAWYQQKPGQAPRLLIYSASNLESGIPARFSGSGSGTDFTLTISSLEPEDFAVYYCQQSRTEPFTFGQGTKLEIK

SEQ ID NO: 2101 - protein, 107 aa, Artificial Sequence
  Description of Artificial Sequence: Synthetic polypeptide
EIVLTQSPATLSLSPGERATLSCRASQSVSTPMHWYQQKPGQAPRLLIYSASNLESGIPARFSDSGSGTDFTLTISSLEPEDFAVYYCQQFWDDPYTFGQGTKLEIK

SEQ ID NO: 2102 - protein, 107 aa, Artificial Sequence
  Description of Artificial Sequence: Synthetic polypeptide
EIVLTQSPATLSLSPGERATLSCRASESVITHLAWYQQKPGQAPRLLIYSASILESGIPARFSGSGSGTDFTLTISSLEPEDFAVYYCQQCCIDPFTFGQGTKLEIK

SEQ ID NO: 2103 - protein, 107 aa, Artificial Sequence
  Description of Artificial Sequence: Synthetic polypeptide
  MOD_RES (92)..(92): Any amino acid
EIVLTQSPATLSLSPGERATLSCRASQSVRSQLAWYQQKPGQAPRLLIYVASNLESGVPARFSGSGSGTDFTLTISSLEPEDFAVYYCQQSXNDPFTFGQGTKLEIK

SEQ ID NO: 2104 - protein, 107 aa, Artificial Sequence
  Description of Artificial Sequence: Synthetic polypeptide
EIVLTQSPATLSLSPGERATLSCRASESVRTHMHWYQQKPGQAPRLLIYGASKLESGVPARFSGSGSGTDFTLTISSLEPEDFAVYYCQQSWIDPFTFGQGTKLEIK

SEQ ID NO: 2105 - protein, 107 aa, Artificial Sequence
  Description of Artificial Sequence: Synthetic polypeptide
EIVLTQSPATLSLSPGERATLSCRASESVSIHLAWYQQKPGQAPRLLIYGASNLESGVPARFSGSGSGTDFTLTISSLEPEDFAVYYCQQSWNDPFTFGQGTKLEIK

SEQ ID NO: 2106 - protein, 107 aa, Artificial Sequence
  Description of Artificial Sequence: Synthetic polypeptide
EIVLTQSPATLSLSPGERATLSCRASQSVSTPMHWYQQKPGQAPRLLIYGASYLESGVPARFSGSGSGTDFTLTISSLEPEDFAVYYCQQSWNEPYTFGQGTKLEIK

SEQ ID NO: 2107 - protein, 107 aa, Artificial Sequence
  Description of Artificial Sequence: Synthetic polypeptide
EIVLTQSPATLSLSPGERATLSCRASESVSAHMHWYQQKPGQAPRLLIYGASNLESGVPARFSGSGSGTDFTLTISSLEPEDFAVYYCQQSWIYPFTFGQGTKLEIK

SEQ ID NO: 2108 - protein, 107 aa, Artificial Sequence
  Description of Artificial Sequence: Synthetic polypeptide
  MOD_RES (92)..(92): Any amino acid
EIVLTQSPATLSLSPGERATLSCRASQSVRTHMHWYQQKPGQAPRLLIYGASHLESGIPARFSGSGSGIDFTLTISSLEPEDFAVYYCQQSXRYPFTFGQGTKLEIK

SEQ ID NO: 2109 - protein, 107 aa, Artificial Sequence
  Description of Artificial Sequence: Synthetic polypeptide
EIVLTQSPATLSLSPGERATLSCRASQSVRTHMHWYQQKPGQAPRLLIYRASNLESGIPARFSGSGSGTDFTLTISSLEPEDFAVYYCQQRSNEPFTFGQGTKLEIK

SEQ ID NO: 2110 - protein, 107 aa, Artificial Sequence
  Description of Artificial Sequence: Synthetic polypeptide
EIVLTQSPATLSLSPGERATLSCRASQSVRSHMHWYQQKPGQAPRLLIYGASGLESGIPARFSGSGSGTDFTLTISSLEPEDFAVYFCQQRWNEPSTFGQGTKLEIK

SEQ ID NO: 2111 - protein, 107 aa, Artificial Sequence
  Description of Artificial Sequence: Synthetic polypeptide
EIVLTQSPATLSLSPGERATLSCRASQSVRFHMHWYQQKPGQAPRLLIYGASPLESGIPARFSGSGSGTDFTLTISSLEPEDFAVYYCQQSRRHPFTFGQGTKLEIK

SEQ ID NO: 2112 - protein, 107 aa, Artificial Sequence
  Description of Artificial Sequence: Synthetic polypeptide
EIVLTQSPATLSLSPGERATLSCRASQSVSIQMHWYQQKPGQAPRLLIYGASKLESGIPARFSGSGSGTDFTLTISSLEPEDFAVYYCQQQWNVPFTFGQGTKLEIK

SEQ ID NO: 2113 - protein, 107 aa, Artificial Sequence
  Description of Artificial Sequence: Synthetic polypeptide
EIVLTQSPATLSLSPGERATLSCRASQSVSTPMHWYQQKPGQAPRLLIYRASNLESGIPARFSGSGSGTDFTLTISSLEPEDFAVYYCQQGGNDPYTFGQGTKLEIK

SEQ ID NO: 2114 - protein, 107 aa, Artificial Sequence
  Description of Artificial Sequence: Synthetic polypeptide
EIVLTQSPATLSLSPGERATLSCRASESVSTHMHWYQQKPGQAPRLLIYWASDLESGVPARFSGSGSGTDFTLTISSLEPEDFAVYYCQQCWNGPLTFGQGTKLEIK

SEQ ID NO: 2115 - protein, 107 aa, Artificial Sequence
  Description of Artificial Sequence: Synthetic polypeptide
  MOD_RES (87)..(87): Any amino acid
EIVLTQSPATLSLSPGERATFSCRASESVSTHMHWYQQKPGQAPRLLIYGASNLESGVPARFSGSGCGTDFTLTISSLEPEDFAVYXCQQSGNDPFTFGQGTKLEIK

SEQ ID NO: 2116 - protein, 107 aa, Artificial Sequence
  Description of Artificial Sequence: Synthetic polypeptide
EIVLTQSPATLSLSPGERATLSCRASQSVSTHMHWYQQKPGQAPRLLIYRASNLESGIPARFSGSGSGTDFTLTISSLEPEDFAVYYCQQGGNVPCTFGQGTKLEIK

SEQ ID NO: 2117 - protein, 107 aa, Artificial Sequence
  Description of Artificial Sequence: Synthetic polypeptide
EIVLTQSPATLSLSPGERATLSCRASESVSWHMHWYQQKPGQAPRLLIYGASNLESGIPARFSGSGSGTDFTLTISSLEPEDFAVYYCQQIRADPFTFGQGTKLEIK

SEQ ID NO: 2118 - protein, 107 aa, Artificial Sequence
  Description of Artificial Sequence: Synthetic polypeptide
EIVLTQSPATLSLSPGERATLSCRASESVCAHMHWYQQKPGQAPRLLIYWASKLESGVPARFSGSGSGTDFTLTISSLEPEDFAVYYCQQSGLDPVTFGQGTKLEIK

SEQ ID NO: 2119 - protein, 107 aa, Artificial Sequence
  Description of Artificial Sequence: Synthetic polypeptide
EIVLTQSPATLSLSPGERATLSCRASESVSTQMHWYQQKPGQAPRLLIYGASILESGIPARFSGSGSGTDFTLTISSLEPEDFAVYFCQQSGNNPFTFGQGTKLEIK

SEQ ID NO: 2120 - protein, 107 aa, Artificial Sequence
  Description of Artificial Sequence: Synthetic polypeptide
EIVLTQSPATLSLSPGERATLSCRASQSVSTLMHWYQQKPGQAPRLLIYRASILESGVPARFSGSGSGTDFTLTISSLEPEDFAVYYCQQGWNKPFTFGQGTKLEIK

SEQ ID NO: 2121 - protein, 107 aa, Artificial Sequence
  Description of Artificial Sequence: Synthetic polypeptide
EIVLTQSPATLSLSPGERATLSCRASQSVTTHLAWYQQKPGQAPRLLIYWASNLESGVPARFSGSGSGTDFTLTISSLEPEDFAVYYCQQSSKNPFTFGQGTKLEIK

SEQ ID NO: 2122 - protein, 107 aa, Artificial Sequence
  Description of Artificial Sequence: Synthetic polypeptide
  MOD_RES (31)..(31): Any amino acid
EIVLTQSPATLSLSPGERATLSCRASESVSXHMHWYQQKPGQAPRLLIYWASNLESGIPARFSGSGSGTDFTLTISSLEPEDFAVYFCQQSWNDPPTFGQGTKLEIK

SEQ ID NO: 2123 - protein, 107 aa, Artificial Sequence
  Description of Artificial Sequence: Synthetic polypeptide
EIVLTQSPATLSLSPGERATLSCRASQSVSSHLAWYQQKPGQAPRLLIYGASKLESGIPARFSGSGSGTDFTLTISSLEPEDFAVYYCQQSSRDPFTFGQGTKLEIK

SEQ ID NO: 2124 - protein, 107 aa, Artificial Sequence
  Description of Artificial Sequence: Synthetic polypeptide
EIVLTQSPATLSLSPGERATLSCRASQSVTTNMHWYQQKPGQAPRLLIYGASNLESGIPARFSGSGSGTDFTLTISSLEPEDFAVYFCQQRWNDPFTFGQGTKLEIK

SEQ ID NO: 2125 - protein, 107 aa, Artificial Sequence
  Description of Artificial Sequence: Synthetic polypeptide
  MOD_RES (94)..(94): Any amino acid
EIVLTQSPATLSLSPGERATLSCRASQSVSTHLAWYQQKPGQAPRLLIYGASNLESGIPARFSGSGSGTDFTLTISSLEPEDFAVYYCQQKSNXPFTFGQGTKLEIK

SEQ ID NO: 2126 - protein, 107 aa, Artificial Sequence
  Description of Artificial Sequence: Synthetic polypeptide
EIVLTQSPATLSLSPGERATLSCRASQSVSTHMHWYQQKPGQAPRLLIYRASNLESGVPARFSGSGSGTDFTLTISSLEPEDFAVYFCQQSWKDPYTFGQGTKLEIK

SEQ ID NO: 2127 - protein, 107 aa, Artificial Sequence
  Description of Artificial Sequence: Synthetic polypeptide
EIVLTQSPATLSLSPGERATLSCRASQSVSAHLAWYQQKPGQAPRLLIYEASNLESGVPARFSGSGSGTDFTLTISSLEPEDFAVYYCQQSWNVPFTFGQGTKLEIK

SEQ ID NO: 2128 - protein, 107 aa, Artificial Sequence
  Description of Artificial Sequence: Synthetic polypeptide
EIVLTQSPATLSLSPGERATLSCRASESVLILMHWYQQKPGQAPRLLIYEASNLESGVPARFSGSGSGTDFTLTISSLEPEDFAVYFCQQSSNDPFTFGQGTKLEIK

SEQ ID NO: 2129 - protein, 107 aa, Artificial Sequence
  Description of Artificial Sequence: Synthetic polypeptide
  MOD_RES (92)..(92): Any amino acid
EIVLTQSPATLSLSPGERATLSCRASQSVSSLMHWYQQKPGQAPRLLIYGASCLESGIPARFSGSGSGTDFTLTISSLEPEDFAVYFCQQYXNDPYTFGQGTKLEIK

SEQ ID NO: 2130 - protein, 107 aa, Artificial Sequence
  Description of Artificial Sequence: Synthetic polypeptide
EIVLTQSPATLSLSPGERATLSCRASQSVITHMHWYQQKPGQAPRLLIYGASNLESGIPARFSGSGSGTDFTLTISSLEPEDFAVYYCQQRWKFPFTFGQGTKLEIK

SEQ ID NO: 2131 - protein, 107 aa, Artificial Sequence
  Description of Artificial Sequence: Synthetic polypeptide
EIVLTQSPATLSLSPGERATLSCRASESVSTQLAWYQQKPGQAPRLLIYGASNLESGVPARFSGSGSGTDFTLTISSLEPEDFAVYYCQQNWNNPLTFGQGTKLEIK

SEQ ID NO: 2132 - protein, 107 aa, Artificial Sequence
  Description of Artificial Sequence: Synthetic polypeptide
EIVLTQSPATLSLSPGERATLSCRASQSVSRDMHWYQQKPGQAPRLLIYGASYLESGIPARFSGSGSGTDFTLTISSLEPEDFAVYFCQQRWKEPFTFGQGTKLEIK

SEQ ID NO: 2133 - protein, 107 aa, Artificial Sequence
  Description of Artificial Sequence: Synthetic polypeptide
EIVLTQSPATLSLSPGERATLSCRASQSVTTLMHWYQQKPGQAPRLLIYGASNLESGIPARFSGSGSGTDFTLTISSLEPEDFAVYYCQQGCNDPLTFGQGTKLEIK

SEQ ID NO: 2134 - protein, 107 aa, Artificial Sequence
  Description of Artificial Sequence: Synthetic polypeptide
EIVLTQSPATLSLSPGERATLSCRASESVVTHMHWYQQKPGQAPRLLIYRASGLESGIPARFSGSGSGTDFTLTISSLEPEDFAVYYCQQSWQHPFTFGQGTKLEIK

SEQ ID NO: 2135 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQSGNDPCTFGQGTKLEIK

SEQ ID NO: 2136 - protein, 107 aa, Artificial Sequence
  Description of Artificial Sequence: Synthetic polypeptide
EIVLTQSPATLSLSPGERATLSCRASQSVNSYLAWYQQKPGQAPRLLIYWASNLESGVPARFSGSGSGTDFTLTISSLEPEDFAVYYCQQAWNDPSTFGQGTKLEIK

SEQ ID NO: 2137 - protein, 107 aa, Artificial Sequence
  Description of Artificial Sequence: Synthetic polypeptide
EIVLTQSPATLSLSPGERATLSCRASQSVSNPMHWYQQKPGQAPRLLIYGASNLESGVPARFSGSGSGTDFTLTISSLEPEDFAVYFCQQSWNDPFTFGQGTKLEIK

SEQ ID NO: 2138 - protein, 107 aa, Artificial Sequence
  Description of Artificial Sequence: Synthetic polypeptide
EIVLTQSPATLSLSPGERATLSCRASQSVSTLMHWYQQKPGQAPRLLIYGASNLESGVPARFSGSGSGTDFTLTISSLEPEDFAVYYCQQGLTDPFTFGQGTKLEIK

SEQ ID NO: 2139 - protein, 107 aa, Artificial Sequence
  Description of Artificial Sequence: Synthetic polypeptide
EIVLTQSPATLSLSPGERATLSCRASESVSPPLAWYQQKPGQAPRLLIYGASHLESGVPARFSGSGSGTDFTLTISSLEPEDFAVYFCQQSENDPLTFGQGTKLEIK

SEQ ID NO: 2140 - protein, 107 aa, Artificial Sequence
  Description of Artificial Sequence: Synthetic polypeptide
EIVLTQSPATLSLSPGERATLSCRASESVNTHMHWYQQKPGQAPRLLIYGASNLESGIPARFSGSGSGTDFTLTISSLEPEDFAVYFCQQTWNHPFTFGQGTKLEIK

SEQ ID NO: 2141 - protein, 107 aa, Artificial Sequence
  Description of Artificial Sequence: Synthetic polypeptide
EIVLTQSPATLSLSPGERATLSCRASESVSYPMHWYQQKPGQAPRLLIYGASRLESGIPARFSGSGSGTDFTLTISSLEPEDFAVYYCQQRWSDPFTFGQGTKLEIK

SEQ ID NO: 2142 - protein, 107 aa, Artificial Sequence
  Description of Artificial Sequence: Synthetic polypeptide
  MOD_RES (92)..(92): Any amino acid
EIVLTQSPATLSLSPGERATLSCRASESVSTHMHWYQQKPGQAPRLLIYIASFLESGVPARFSGSGSGTDFTLTISSLEPEDFAVYYCQQSXFEPSTFGQGTKLEIK

SEQ ID NO: 2143 - protein, 107 aa, Artificial Sequence
  Description of Artificial Sequence: Synthetic polypeptide
EIVLTQSPATLSLSPGERATLSCRASESVSTQMHWYQQKPGQAPRLLIYGASYLESGIPARFSGSGSGTDFTLTISSLEPEDFAVYYCQQSWKDPFTFGQGTKLEIK

SEQ ID NO: 2144 - protein, 107 aa, Artificial Sequence
  Description of Artificial Sequence: Synthetic polypeptide
EIVLTQSPATLSLSPGERATLSCRASQSVSTKMHWYQQKPGQAPRLLIYRASNLESGIPARFSGSGSGTDFTLTISSLEPEDFAVYYCQQSWIDPFTFGQGTKLEIK

SEQ ID NO: 2145 - protein, 107 aa, Artificial Sequence
  Description of Artificial Sequence: Synthetic polypeptide
EIVLTQSPATLSLSPGERATLSCRASQSVGTHMHWYQQKPGQAPRLLIYRASYLESGIPARFSGSGSGTDFTLTISSLEPEDFAVYYCQQSWKDPFTFGQGTKLEIK

SEQ ID NO: 2146 - protein, 107 aa, Artificial Sequence
  Description of Artificial Sequence: Synthetic polypeptide
EIVLTQSPATLSLSPGERATLSCRASQSVMTHLAWYQQKPGQAPRLLIYGASNLESGVPARFSGSGSGTDFTLTISSLEPEDFAVYYCQQSWNEPFTFGQGTKLEIK

SEQ ID NO: 2147 - protein, 107 aa, Artificial Sequence
  Description of Artificial Sequence: Synthetic polypeptide
  MOD_RES (30)..(30): Any amino acid
EIVLTQSPATLSLSPGERATLSCRASQSVXTHLAWYQQKPGQAPRLLIYGASKLESGIPARFSGSGSGTDFTLTISSLEPEDFAVYYCQQSWQDPITFGQGTKLEIK

SEQ ID NO: 2148 - protein, 107 aa, Artificial Sequence
  Description of Artificial Sequence: Synthetic polypeptide
  MOD_RES (87)..(88): Any amino acid
EIVLTQSPATLSLSPGERATLSCRASQSVSTHMHWYQQKPGQAPRLLIYAASKLESGVPARFSGSGSGTDFTLTISSLEPEDFAVYXXQQSWNDPFTFGQGTKLEIK

SEQ ID NO: 2149 - protein, 107 aa, Artificial Sequence
  Description of Artificial Sequence: Synthetic polypeptide
EIVLTQSPATLSLSPGERATLSCRASQSVSSLMHWYQQKPGQAPRLLIYVASNLESGIPARFSGSGSGTDFTLTISSLEPEDFAVYYCQQSWNYPFTFGQGTKLEIK

SEQ ID NO: 2150 - protein, 107 aa, Artificial Sequence
  Description of Artificial Sequence: Synthetic polypeptide
EIVLTQSPATLSLSPGERATLSCRASQSVITPLAWYQQKPGQAPRLLIYGASRLESGVPARFSGSGSGTDFTLTISSLEPEDFAVYYCQQIWNDPFTFGQGTKLEIK

SEQ ID NO: 2151 - protein, 107 aa, Artificial Sequence
  Description of Artificial Sequence: Synthetic polypeptide
EIVLTQSPATLSLSPGERATLSCRASQSVSPLLAWYQQKPGQAPRLLIYGASNLESGIPARFSGSGSGTDFTLTISSLEPEDFAVYYCQQRWNEPFTFGQGTKLEIK

SEQ ID NO: 2152 - protein, 107 aa, Artificial Sequence
  Description of Artificial Sequence: Synthetic polypeptide
EIVLTQSPATLSLSPGERATLSCRASQSVNPHLAWYQQKPGQAPRLLIYWASSLESGVPARFSGSGSGTDFTLTISSLEPEDFAVYYCQQNWNDPFTFGQGTKLEIK

SEQ ID NO: 2153 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASRLESGVPARFSGSGSGTDFTLTISSLEPEDFAVYYCQQGWNYPFTFGQGTKLEIK

SEQ ID NO: 2154 - protein, 107 aa, Artificial Sequence
  Description of Artificial Sequence: Synthetic polypeptide
EIVLTQSPATLSLSPGERATLSCRASQSVSTRMHWYQQKPGQAPRLLIYGASYLESGIPARFSGSGSGTDFTLTISSLEPEDFAVYYCQQTRYDPFTFGQGTKLEIK

SEQ ID NO: 2155 - protein, 107 aa, Artificial Sequence
  Description of Artificial Sequence: Synthetic polypeptide
EIVLTQSPATLSLSPGERATLSCRASESVSSHMHWYQQKPGQAPRLLIYGASRLESGVPARFSGSGSGTDFTLTISSLEPEDFAVYYCQQSWNDPFTFGQGTKLEIK

SEQ ID NO: 2156 - protein, 107 aa, Artificial Sequence
  Description of Artificial Sequence: Synthetic polypeptide
EIVLTQSPATLSLSPGERATLSCRASQSVTTHMHWYQQKPGQAPRLLIYAASNLESGIPARFSGSGSGTDFTLTISSLEPEDFAVYFCQQSWNHPFTFGQGTKLEIK

SEQ ID NO: 2157 - protein, 107 aa, Artificial Sequence
  Description of Artificial Sequence: Synthetic polypeptide
EIVLTQSPATLSLSPGERATLSCRASQSVKTQLAWYQQKPGQAPRLLIYGASNLESGIPARFSGSGSGTDFTLTISSLEPEDFAVYYCQQRCNGPFTFGQGTKLEIK

SEQ ID NO: 2158 - protein, 107 aa, Artificial Sequence
  Description of Artificial Sequence: Synthetic polypeptide
EIVLTQSPATLSLSPGERATLSCRASQSVSTQLAWYQQKPGQAPRLLIYGASHLESGVPARFSGSGSGTDFTLTISSLEPEDFAVYYCQQTGNDPFTFGQGTKLEIK

SEQ ID NO: 2159 - protein, 107 aa, Artificial Sequence
  Description of Artificial Sequence: Synthetic polypeptide
EIVLTQSPATLSLSPGERATLSCRASESVSPLMHWYQQKPGQAPRLLIYGASNLESGIPARFSGSGSGTDFTLTISSLEPEDFAVYFCQQSWKDPFTFGQGTKLEIK

SEQ ID NO: 2160 - protein, 107 aa, Artificial Sequence
  Description of Artificial Sequence: Synthetic polypeptide
EIVLTQSPATLSLSPGERATLSCRASESVSAHMHWYQQKPGQAPRLLIYGASKLESGVPARFSGSGSGTDFTLTISSLEPEDFAVYYCQQWWNNPFTFGQGTKLEIK

SEQ ID NO: 2161 - protein, 107 aa, Artificial Sequence
  Description of Artificial Sequence: Synthetic polypeptide
EIVLTQSPATLSLSPGERATLSCRASQSVNTHMHWYQQKPGQAPRLLIYRASNLESGVPARFSGSGSGTDFTLTISSLEPEDFAVYYCQQSWNEPLTFGQGTKLEIK

SEQ ID NO: 2162 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYFCQQSWQDPLTFGQGTKLEIK

SEQ ID NO: 2163 - protein, 107 aa, Artificial Sequence
  Description of Artificial Sequence: Synthetic polypeptide
EIVLTQSPATLSLSPGERATLSCRASQSVNTNMHWYQQKPGQAPRLLIYGASILESGIPARFSGSGSGTDFTLTISSLEPEDFAVYYCQQTWNVPFTFGQGTKLEIK

SEQ ID NO: 2164 - protein, 107 aa, Artificial Sequence
  Description of Artificial Sequence: Synthetic polypeptide
EIVLTQSPATLSLSPGERATLSCRASESVSTAMHWYQQKPGQAPRLLIYGASNLESGVPARFSGSGSGTDFTLTISSLEPEDFAVYFCQQTWNVPITFGQGTKLEIK

SEQ ID NO: 2165 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASMLESGVPARFSGSGSGTDFTLTISSLEPEDFAVYYCQQSWNDPLTFGQGTKLEIK

SEQ ID NO: 2166 - protein, 107 aa, Artificial Sequence
  Description of Artificial Sequence: Synthetic polypeptide
EIVLTQSPATLSLSPGERATLSCRASESVNDHMHWYQQKPGQAPRLLIYGASNLESGVPARFSGSGSGTDFTLTISSLEPEDFAVYYCQQSWNNPITFGQGTKLEIK

SEQ ID NO: 2167 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASYLESGVPARFSGSGSGTDFTLTISSLEPEDFAVYFCQQSWNDPLTFGQGTKLEIK

SEQ ID NO: 2168 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYFCQQTWDDPITFGQGTKLEIK

SEQ ID NO: 2169 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASKLESGVPARFSGSGSGTDFTLTISSLEPEDFAVYFCQQSFLDPITFGQGTKLEIK

SEQ ID NO: 2170 - protein, 107 aa, Artificial Sequence
  Description of Artificial Sequence: Synthetic polypeptide
EIVLTQSPATLSLSPGERATLSCRASESVSTNMHWYQQKPGQAPRLLIYGASILESGVPARFSGSGSGTDFTLTISSLEPEDFAVYYCQQGWSDPLTFGQGTKLEIK

SEQ ID NO: 2171 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWIDPLTFGQGTKLEIK

SEQ ID NO: 2172 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGVPARFSGSGSGTDFTLTISSLEPEDFAVYYCQQSWIDPITFGQGTKLEIK

SEQ ID NO: 2173 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGVPARFSGSGCGTDFTLTISSLEPEDFAVYFCQQSWHDPLTFGQGTKLEIK

SEQ ID NO: 2174 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASILESGVPARFSGSGSGTDFTLTISSLEPEDFAVYFCQQTWDDPITFGQGTKLEIK

SEQ ID NO: 2175 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASELESGVPARFSGSGSGTDFTLTISSLEPEDFAVYYCQQTWNDPITFGQGTKLEIK

SEQ ID NO: 2176 - protein, 107 aa, Artificial Sequence
  Description of Artificial Sequence: Synthetic polypeptide
EIVLTQSPATLSLSPGERATLSCRASESVNTLMHWYQQKPGQAPRLLIYGASHLESGIPARFSGSGSGTDFTLTISSLEPEDFAVYYCQQTWNEPITFGQGTKLEIK

SEQ ID NO: 2177 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQTWSDPLTFGQGTKLEIK

SEQ ID NO: 2178 - protein, 107 aa, Artificial Sequence
  Description of Artificial Sequence: Synthetic polypeptide
EIVLTQSPATLSLSPGERATLSCRASQSVSKHMHWYQQKPGQAPRLLIYGASNLESGIPARFSGSGSGTDFTLTISSLEPEDFAVYYCQQSWNNPITFGQGTKLEIK

SEQ ID NO: 2179 - protein, 107 aa, Artificial Sequence
  Description of Artificial Sequence: Synthetic polypeptide
EIVLTQSPATLSLSPGERATLSCRASQSVDTHMHWYQQKPGQAPRLLIYGASILESGVPARFSGSGSGTDFTLTISSLEPEDFAVYYCQQSWHDPITFGQGTKLEIK

SEQ ID NO: 2180 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASKLESGVPARFSGSGSGTDFTLTISSLEPEDFAVYFCQQSWTDPLTFGQGTKLEIK

SEQ ID NO: 2181 - protein, 107 aa, Artificial Sequence
  Description of Artificial Sequence: Synthetic polypeptide
EIVLTQSPATLSLSPGERATLSCRASQSVSSHMHWYQQKPGQAPRLLIYGASHLESGVPARFSGSGSGTDFTLTISSLEPEDFAVYFCQQSWNDPLTFGQGTKLEIK

SEQ ID NO: 2182 - protein, 107 aa, Artificial Sequence
  Description of Artificial Sequence: Synthetic polypeptide
EIVLTQSPATLSLSPGERATLSCRASESVSTNMHWYQQKPGQAPRLLIYAASNLESGVPARFSGSGSGTDFTLTISSLEPEDFAVYFCQQSWNEPFTFGQGTKLEIK

SEQ ID NO: 2183 - protein, 107 aa, Artificial Sequence
  Description of Artificial Sequence: Synthetic polypeptide
EIVLTQSPATLSLSPGERATLSCRASQSVDTHMHWYQQKPGQAPRLLIYGASNLESGVPARFSGSGSGTDFTLTISSLEPEDFAVYYCQQSWGDPLTFGQGTKLEIK

SEQ ID NO: 2184 - protein, 107 aa, Artificial Sequence
  Description of Artificial Sequence: Synthetic polypeptide
EIVLTQSPATLSLSPGERATLSCRASESVSNNLAWYQQKPGQAPRLLIYGASHLESGIPARFSGSGSGTDFTLTISSLEPEDFAVYYCQQTWNDPITFGQGTKLEIK

SEQ ID NO: 2185 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQSWNDPITFGQGTKLEIK

SEQ ID NO: 2186 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGVPARFSGSGSGTDFTLTISSLEPEDFAVYFCQQSWNEPWTFGQGTKLEIK

SEQ ID NO: 2187 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASKLESGIPARFSGSGSGTDFTLTISSLEPEDFAVYYCQQSWIDPLTFGQGTKLEIK

SEQ ID NO: 2188 - protein, 107 aa, Artificial Sequence
  Description of Artificial Sequence: Synthetic polypeptide
EIVLTQSPATLSLSPGERATLSCRASQSVGNNMHWYQQKPGQAPRLLIYGASHLESGIPARFSGSGSGTDFTLTISSLEPEDFAVYYCQQSWNDPLTFGQGTKLEIK

SEQ ID NO: 2189 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFGGSGSGTDFTLTISSLEPEDFAVYYCQQSWTDPLTFGQGTKLEIK

SEQ ID NO: 2190 - protein, 107 aa, Artificial Sequence
  Description of Artificial Sequence: Synthetic polypeptide
  MOD_RES (32)..(32): Any amino acid
EIVLTQSPATLSLSPGERATLSCRASESVYTXLAWYQQKPGQAPRLLIYGASNLESGVPARFSGSGSGTDFTLTISSLEPEDFAVYYCQQILNDPFTFGQGTKLEIK

SEQ ID NO: 2191 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWNDPLTFGQGTKLEIK

SEQ ID NO: 2192 - protein, 107 aa, Artificial Sequence
  Description of Artificial Sequence: Synthetic polypeptide
EIVLTQSPATLSLSPGERATLSCRASQSVGTNMHWYQQKPGQAPRLLIYGASNLESGIPARFSGSGSGTDFTLTISSLEPEDFAVYFCQQSWNDPITFGQGTKLEIK

SEQ ID NO: 2193 - protein, 107 aa, Artificial Sequence
  Description of Artificial Sequence: Synthetic polypeptide
EIVLTQSPATLSLSPGERATLSCRASESVATHMHWYQQKPGQAPRLLIYGASYLESGVPARFSGSGSGTDFTLTISSLEPEDFAVYYCQQSWNDPLTFGQGTKLEIK

SEQ ID NO: 2194 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASHLESGIPARFSGSGSGTDFTLTISSLEPEDFAVYYCQQSWNDPLTFGQGTKLEIK

SEQ ID NO: 2195 - protein, 107 aa, Artificial Sequence
  Description of Artificial Sequence: Synthetic polypeptide
EIVLTQSPATLSLSPGERATLSCRASESVMNHLAWYQQKPGQAPRLLIYGASYLESGIPARFSGSGSGTDFTLTISSLEPEDFAVYYCQQTWSDPLTFGQGTKLEIK

SEQ ID NO: 2196 - protein, 107 aa, Artificial Sequence
  Description of Artificial Sequence: Synthetic polypeptide
EIVLTQSPATLSLSPGERATLSCRASQSVGTSMHWYQQKPGQAPRLLIYAASELESGIPARFSGSGSGTDFTLTISSLEPEDFAVYYCQQSWNDPFTFGQGTKLEIK

SEQ ID NO: 2197 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWNDPLTFGQGTKLEIK

SEQ ID NO: 2198 - protein, 107 aa, Artificial Sequence
  Description of Artificial Sequence: Synthetic polypeptide
EIVLTQSPATLSLSPGERATLSCRASESVSNNMHWYQQKPGQAPRLLIYGASNLESGIPARFSGSGSGTDFTLTISSLEPEDFAVYYCQQTWSDPFTFGQGTKLEIK

SEQ ID NO: 2199 - protein, 107 aa, Artificial Sequence
  Description of Artificial Sequence: Synthetic polypeptide
EIVLTQSPATLSLSPGERATLSCRASQSVSSHMHWYQQKPGQAPRLLIYGASKLESGIPARFSGSGSGTDFTLTISSLEPEDFAVYYCQQSFSDPITFGQGTKLEIK

SEQ ID NO: 2200 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGIPARFSGSGSGTDFTLTISSLEPEDFAVYYCQQSWSDPLTFGQGTKLEIK

SEQ ID NO: 2201 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASHLESGIPARFSGSGSGTDFTLTISSLEPEDFAVYYCQQSWNDPLTFGQGTKLEIK

SEQ ID NO: 2202 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQSWNPPITFGQGTKLEIK

SEQ ID NO: 2203 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYYCQQSWNEPFTFGQGTKLEIK

SEQ ID NO: 2204 - protein, 107 aa, Artificial Sequence
  Description of Artificial Sequence: Synthetic polypeptide
EIVLTQSPATLSLSPGERATLSCRASQSVGTNMHWYQQKPGQAPRLLIYGASILESGIPARFSGSGSGTDFTLTISSLEPEDFAVYYCQQTWNEPITFGQGTKLEIK

SEQ ID NO: 2205 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQTWYDPVTFGQGTKLEIK

SEQ ID NO: 2206 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGVPARFSGSGSGTDFTLTISSLEPEDFAVYFCQQTWNDPLTFGQGTKLEIK

SEQ ID NO: 2207 - protein, 107 aa, Artificial Sequence
  Description of Artificial Sequence: Synthetic polypeptide
EIVLTQSPATLSLSPGERATLSCRASQSVSSHMHWYQQKPGQAPRLLIYGASILESGVPARFSGSGSGTDFTLTISSLEPEDFAVYYCQQSWYDPLTFGQGTKLEIK

SEQ ID NO: 2208 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWYDPLTFGQGTKLEIK

SEQ ID NO: 2209 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQTWSDPLTFGQGTKLEIK

SEQ ID NO: 2210 - protein, 107 aa, Artificial Sequence
  Description of Artificial Sequence: Synthetic polypeptide
EIVLTQSPATLSLSPGERATLSCRASESVSTHMNWYQQKPGQAPRLLIYGASNLESGIPARFSGSGSGTDFTLTISSLEPEDFAVYYCQQSWNVPYTFGQGTKLEIK

SEQ ID NO: 2211 - protein, 107 aa, Artificial Sequence
  Description of Artificial Sequence: Synthetic polypeptide
EIVLTQSPATLSLSPGERATLSCRASESVTSNMHWYQQKPGQAPRLLIYAASILESGVPARFSGSGSGTDFTLTISSLEPEDFAVYYCQQSWQNPITFGQGTKLEIK

SEQ ID NO: 2212 - protein, 107 aa, Artificial Sequence
  Description of Artificial Sequence: Synthetic polypeptide
EIVLTQSPATLSLSPGERATLSCRASESVSDHMHWYQQKPGQAPRLLIYGASNLESGIPARFSGSGSGTDFTLTISSLEPEDFAVYYCQQSWTDPLTFGQGTKLEIK

SEQ ID NO: 2213 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWNDPLTFGQGTKLEIK

SEQ ID NO: 2214 - protein, 107 aa, Artificial Sequence
  Description of Artificial Sequence: Synthetic polypeptide
EIVLTQSPATLSLSPGERATLSCRASESVSNYMHWYQQKPGQAPRLLIYGASNLESGIPARFSGSGSGTDFTLTISSLEPEDFAVYYCQQSWTDPLTFGQGTKLEIK

SEQ ID NO: 2215 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGIPARFSGSGSGTDFTLTISSLEPEDFAVYYCQQTWNDPITFGQGTKLEIK

SEQ ID NO: 2216 - protein, 107 aa, Artificial Sequence
  Description of Artificial Sequence: Synthetic polypeptide
EIVLTQSPATLSLSPGERATLSCRASQSVGTAMHWYQQKPGQAPRLLIYGASNLESGIPARFSGSGSGTDFTLTISSLEPEDFAVYFCQQSWDAPFTFGQGTKLEIK

SEQ ID NO: 2217 - protein, 107 aa, Artificial Sequence
  Description of Artificial Sequence: Synthetic polypeptide
EIVLTQSPATLSLSPGERATLSCRASQSVRSHMHWYQQKPGQAPRLLIYGASNLESGVPARFSGSGSGTDFTLTISSLEPEDFAVYYCQQSWTPPITFGQGTKLEIK

SEQ ID NO: 2218 - protein, 107 aa, Artificial Sequence
  Description of Artificial Sequence: Synthetic polypeptide
EIVLTQSPATLSLSPGERATLSCRASESVSTSMNWYQQKPGQAPRLLIYGASNLESGIPARFSGSGSGTDFTLTISSLEPEDFAVYYCQQSWKDPITFGQGTKLEIK

SEQ ID NO: 2219 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWNVPWTFGQGTKLEIK

SEQ ID NO: 2220 - protein, 107 aa, Artificial Sequence
  Description of Artificial Sequence: Synthetic polypeptide
EIVLTQSPATLSLSPGERATLSCRASESVSNSMHWYQQKPGQAPRLLIYGASTLESGIPARFSGSGSGTDFTLTISSLEPEDFAVYFCQQTWTDPLTFGQGTKLEIK

SEQ ID NO: 2221 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYFCQQTWNDPSTFGQGTKLEIK

SEQ ID NO: 2222 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYYCQQSWNDPLTFGQGTKLEIK

SEQ ID NO: 2223 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASTLESGVPARFSGSGSGTDFTLTISSLEPEDFAVYYCQQTWSDPLTFGQGTKLEIK

SEQ ID NO: 2224 - protein, 107 aa, Artificial Sequence
  Description of Artificial Sequence: Synthetic polypeptide
EIVLTQSPATLSLSPGERATLSCRASESVDSNMHWYQQKPGQAPRLLIYRASILESGIPARFSGSGSGTDFTLTISSLEPEDFAVYYCQQTWGDPITFGQGTKLEIK

SEQ ID NO: 2225 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASYLESGVPARFSGSGSGTDFTLTISSLEPEDFAVYYCQQSWNDPLTFGQGTKLEIK

SEQ ID NO: 2226 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASYLESGIPARFSGSGSGTDFTLTISSLEPEDFAVYYCQQSWNDPLTFGQGTKLEIK

SEQ ID NO: 2227 - protein, 107 aa, Artificial Sequence
  Description of Artificial Sequence: Synthetic polypeptide
EIVLTQSPATLSLSPGERATLSCRASESVSDHMHWYQQKPGQAPRLLIYGASKLESGVPARFSGSGSGTDFTLTISSLEPEDFAVYYCQQSWTDPLTFGQGTKLEIK

SEQ ID NO: 2228 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYYCQQSWNDPLTFGQGTKLEIK

SEQ ID NO: 2229 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQTWSDPLTFGQGTKLEIK

SEQ ID NO: 2230 - protein, 107 aa, Artificial Sequence
  Description of Artificial Sequence: Synthetic polypeptide
EIVLTQSPATLSLSPGERATLSCRASESVNTHLAWYQQKPGQAPRLLIYGASMLESGVPARFSGSGSGTDFTLTISSLEPEDFAVYFCQQSWSLPYTFGQGTKLEIK

SEQ ID NO: 2231 - protein, 107 aa, Artificial Sequence
  Description of Artificial Sequence: Synthetic polypeptide
EIVLTQSPATLSLSPGERATLSCRASQSVSSHMHWYQQKPGQAPRLLIYGASNLESGVPARFSGSGSGTDFTLTISSLEPEDFAVYYCQQSWNDPLTFGQGTKLEIK

SEQ ID NO: 2232 - protein, 107 aa, Artificial Sequence
  Description of Artificial Sequence: Synthetic polypeptide
EIVLTQSPATLSLSPGERATLSCRASESVSTHMNWYQQKPGQAPRLLIYGASNLESGVPARFSGSGSGTDFTLTISSLEPEDFAVYFCQQSWNDPFTFGQGTKLEIK

SEQ ID NO: 2233 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGVPARFSGSGSGTDFTLTISSLEPEDFAVYFCQQSWNEPYTFGQGTKLEIK

SEQ ID NO: 2234 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASKLESGVPARFSGSGSGTDFTLTISSLEPEDFAVYYCQQTWGDPITFGQGTKLEIK

SEQ ID NO: 2235 - protein, 107 aa, Artificial Sequence
  Description of Artificial Sequence: Synthetic polypeptide
EIVLTQSPATLSLSPGERATLSCRASQSVSTNMHWYQQKPGQAPRLLIYAASNLESGVPARFSGSGSGTDFTLTISSLEPEDFAVYYCQQTWNEPITFGQGTKLEIK

SEQ ID NO: 2236 - protein, 107 aa, Artificial Sequence
  Description of Artificial Sequence: Synthetic polypeptide
EIVLTQSPATLSLSPGERATLSCRASESVGKHMHWYQQKPGQAPRLLIYGASKLESGIPARFSGSGSGTDFTLTISSLEPEDFAVYYCQQTWNDPITFGQGTKLEIK

SEQ ID NO: 2237 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASFLESGVPARFSGSGSGTDFTLTISSLEPEDFAVYYCQQTWTNPITFGQGTKLEIK

SEQ ID NO: 2238 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQSWDDPLTFGQGTKLEIK

SEQ ID NO: 2239 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASYLESGIPARFSGSGSGTDFTLTISSLEPEDFAVYYCQQSWTDPITFGQGTKLEIK

SEQ ID NO: 2240 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASHLESGVPARFSGSGSGTDFTLTISSLEPEDFAVYYCQQSWIDPITFGQGTKLEIK

SEQ ID NO: 2241 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASKLESGIPARFSGSGSGTDFTLTISSLEPEDFAVYYCQQSWNDPITFGQGTKLEIK

SEQ ID NO: 2242 - protein, 107 aa, Artificial Sequence
  Description of Artificial Sequence: Synthetic polypeptide
EIVLTQSPATLSLSPGERATLSCRASESVCTRMHWYQQKPGQAPRLLIYGASILESGVPARFSGSGSGTDFTLTISSLEPEDFAVYYCQQSWNDPYTFGQGTKLEIK

SEQ ID NO: 2243 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQTFDDPLTFGQGTKLEIK

SEQ ID NO: 2244 - protein, 107 aa, Artificial Sequence
  Description of Artificial Sequence: Synthetic polypeptide
EIVLTQSPATLSLSPGERATLSCRASQSVGDSLAWYQQKPGQAPRLLIYAASNLESGVPARFSGSGSGTDFTLTISSLEPEDFAVYFCQQTWNVPITFGQGTKLEIK

SEQ ID NO: 2245 - protein, 107 aa, Artificial Sequence
  Description of Artificial Sequence: Synthetic polypeptide
EIVLTQSPATLSLSPGERATLSCRASESVANHLAWYQQKPGQAPRLLIYGASNLESGVPARFSGSGSGTDFTLTISSLEPEDFAVYYCQQSWYDPITFGQGTKLEIK

SEQ ID NO: 2246 - protein, 107 aa, Artificial Sequence
  Description of Artificial Sequence: Synthetic polypeptide
EIVLTQSPATLSLSPGERATLSCRASESVSTHMNWYQQKPGQAPRLLIYGASNLESGVPARFSGSGSGTDFTLTISSLEPEDFAVYYCQQGWYDPLTFGQGTKLEIK

SEQ ID NO: 2247 - protein, 107 aa, Artificial Sequence
  Description of Artificial Sequence: Synthetic polypeptide
EIVLTQSPATLSLSPGERATLSCRASESVSSHMHWYQQKPGQAPRLLIYGASILESGVPARFSGSGSGTDFTLTISSLEPEDFAVYYCQQSWNDPITFGQGTKLEIK

SEQ ID NO: 2248 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWNVPFTFGQGTKLEIK

SEQ ID NO: 2249 - protein, 107 aa, Artificial Sequence
  Description of Artificial Sequence: Synthetic polypeptide
EIVLTQSPATLSLSPGERATLSCRASESVNKHMHWYQQKPGQAPRLLIYGASNLESGVPARFSGSGSGTDFTLTISSLEPEDFAVYFCQQTWIDPFTFGQGTKLEIK

SEQ ID NO: 2250 - protein, 107 aa, Artificial Sequence
  Description of Artificial Sequence: Synthetic polypeptide
EIVLTQSPATLSLSPGERATLSCRASQSVGNHMHWYQQKPGQAPRLLIYGASNLESGVPARFSGSGSGTDFTLTISSLEPEDFAVYYCQQSWNMPITFGQGTKLEIK

SEQ ID NO: 2251 - protein, 107 aa, Artificial Sequence
  Description of Artificial Sequence: Synthetic polypeptide
EIVLTQSPATLSLSPGERATLSCRASESVGEHMHWYQQKPGQAPRLLIYAASNLESGVPARFSGSGSGTDFTLTISSLEPEDFAVYYCQQTWYDPLTFGQGTKLEIK

SEQ ID NO: 2252 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWDVPLTFGQGTKLEIK

SEQ ID NO: 2253 - protein, 107 aa, Artificial Sequence
  Description of Artificial Sequence: Synthetic polypeptide
ENVLTQSPATLSLSPGERATLSCRASESVITHMNWYQQKPGQAPRLLIYGASILESGVPARFSGSGSGTDFTLTISSLEPEDFAVYYCQQSWNDPFTFGQGTKLEIK

SEQ ID NO: 2254 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASILESGVPARFSGSGSGTDFTLTISSLEPEDFAVYYCQQSWYDPLTFGQGTKLEIK

SEQ ID NO: 2255 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASELESGIPARFSGSGSGTDFTLTISSLEPEDFAVYYCQQSWSDPLTFGQGTKLEIK

SEQ ID NO: 2256 - protein, 107 aa, Artificial Sequence
  Description of Artificial Sequence: Synthetic polypeptide
EIVLTQSPATLSLSPGERATLSCRASQSVDTHMHWYQQKPGQAPRLLIYGASHLESGIPARFSGSGSGTDFTLTISSLEPEDFAVYYCQQSWIDPITFGQGTKLEIK

SEQ ID NO: 2257 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWIDPLTFGQGTKLEIK

SEQ ID NO: 2258 - protein, 107 aa, Artificial Sequence
  Description of Artificial Sequence: Synthetic polypeptide
EIVLTQSPATPSLSPGERATLSCRASESVSTHMHWYQQKPGQAPRLLIYGASNLESGVPARFSGSGSGTDFTLTISSLEPEDFAVYFCQQSWNDPFTFGQGTKLEIK

SEQ ID NO: 2259 - protein, 107 aa, Artificial Sequence
  Description of Artificial Sequence: Synthetic polypeptide
EIVLTQSPATLSLSPGERATLSCRASESVSSHMHWYQQKPGQAPRLLIYGASILESGIPARFSGSGSGTDFTLTISSLEPEDFAVYYCQQTWNDPITFGQGTKLEIK

SEQ ID NO: 2260 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASILESGVPARFSGSGSGTDFTLTISSLEPEDFAVYYCQQSWNDPLTFGQGTKLEIK

SEQ ID NO: 2261 - protein, 107 aa, Artificial Sequence
  Description of Artificial Sequence: Synthetic polypeptide
EIVLTQSPATLSLSPGERATLSCRASQSVITHMNWYQQKPGQAPRLLIYGASNLESGVPARFSGSGSGTDFTLTISSLEPEDFAVYYCQQTWNDPITFGQGTKLEIK

SEQ ID NO: 2262 - protein, 107 aa, Artificial Sequence
  Description of Artificial Sequence: Synthetic polypeptide
EIVLTQSPATLSLSPGERATLSCRASESVQTHMNWYQQKPGQAPRLLIYGASNLESGVPARFSGSGSGTDFTLTISSLEPEDFAVYYCQQSWNDPFTFGQGTKLEIK

SEQ ID NO: 2263 - protein, 107 aa, Artificial Sequence
  Description of Artificial Sequence: Synthetic polypeptide
EIVLTQSPATLSLSPGERATLSCRASQSVGTHMHWYQQKPGQAPRLLIYAASNLESGVPARFSGSGSGTDFTLTISSLEPEDFAVYYCQQTWYDPLTFGQGTKLEIK

SEQ ID NO: 2264 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYFCQQSWNDPLTFGQGTKLEIK

SEQ ID NO: 2265 - protein, 107 aa, Artificial Sequence
  Description of Artificial Sequence: Synthetic polypeptide
EIVLTQSPATLSLSPGERATLSCRASESVITHMNWYQQKPGQAPRLLIYGASNLESGVPARFSGSGSGTDFTLTISSLEPEDFAVYFCQQSWDNPITFGQGTKLEIK

SEQ ID NO: 2266 - protein, 107 aa, Artificial Sequence
  Description of Artificial Sequence: Synthetic polypeptide
EIVLTQSPATLSLSPGERATLSCRASQSVHKHMNWYQQKPGQAPRLLIYGASNLESGVPARFSGSGSGTDFTLTISSLEPEDFAVYYCQQGWDDPLTFGQGTKLEIK

SEQ ID NO: 2267 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGIPARFSGSGSGTDFTLTISSLEPEDFAVYYCQQSWNDPLTFGQGTKLEIK

SEQ ID NO: 2268 - protein, 107 aa, Artificial Sequence
  Description of Artificial Sequence: Synthetic polypeptide
EIVLTQSPATLSLSPGERATLSCRASESVLTHMNWYQQKPGQAPRLLIYGASNLESGIPARFSGSGSGTDFTLTISSLEPEDFAVYFCQQTWYEPWTFGQGTKLEIK

SEQ ID NO: 2269 - protein, 107 aa, Artificial Sequence
  Description of Artificial Sequence: Synthetic polypeptide
EIVLTQSPATLSLSPGERATLSCRASESVDTHMHWYQQKPGQAPRLLIYGASNLESGIPARFSGSGSGTDFTLTISSLEPEDFAVYYCQQTWYDPITFGQGTKLEIK

SEQ ID NO: 2270 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQTWSDPITFGQGTKLEIK

SEQ ID NO: 2271 - protein, 107 aa, Artificial Sequence
  Description of Artificial Sequence: Synthetic polypeptide
EIVLTQSPATLSLSPGERATLSCRASQSVGTHMNWYQQKPGQAPRLLIYGASFLESGIPARFSGSGSGTDFTLTISSLEPEDFAVYYCQQSWSDPITFGQGTKLEIK

SEQ ID NO: 2272 - protein, 107 aa, Artificial Sequence
  Description of Artificial Sequence: Synthetic polypeptide
EIVLTQSPATLSLSPGERATLSCRASQSVGTPMHWYQQKPGQAPRLLIYGASTLESGIPARFSGSGSGTDFTLTISSLEPEDFAVYYCQQTWYDPLTFGQGTKLEIK

SEQ ID NO: 2273 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASYLESGIPARFSGSGSGTDFTLTISSLEPEDFAVYYCQQTWYDPITFGQGTKLEIK

SEQ ID NO: 2274 - protein, 107 aa, Artificial Sequence
  Description of Artificial Sequence: Synthetic polypeptide
EIVLTQSPATLSLSPGERATLSCRASESVDTHMHWYQQKPGQAPRLLIYGASILESGVPARFSGSGSGTDFTLTISSLEPEDFAVYYCQQTWYDPITFGQGTKLEIK

SEQ ID NO: 2275 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASMLESGIPARFSGSGSGTDFTLTISSLEPEDFAVYFCQQTWTDPITFGQGTKLEIK

SEQ ID NO: 2276 - protein, 107 aa, Artificial Sequence
  Description of Artificial Sequence: Synthetic polypeptide
  MOD_RES (14)..(14): Any amino acid
EIVLTQSPATLSLXPGERATLSCRASESVSTHMHWYQQKPGQAPRLLIYGASNLEYGVPARFSGSGCGTDFTLTISSIEHEDFAVYFCQQSWNDPFTFGQGTKLEIK

SEQ ID NO: 2277 - protein, 107 aa, Artificial Sequence
  Description of Artificial Sequence: Synthetic polypeptide
EIVLTQSPATLSLSPGERATLSCRASQSVANHLAWYQQKPGQAPRLLIYGASILESGVPARFSGSGSGTDFTLTISSLEPEDFAVYYCQQTWTDPITFGQGTKLEIK

SEQ ID NO: 2278 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASMLESGVPARFSGSGSGTDFTLTISSLEPEDFAVYYCQQSWNNPITFGQGTKLEIK

SEQ ID NO: 2279 - protein, 107 aa, Artificial Sequence
  Description of Artificial Sequence: Synthetic polypeptide
EIVLTQSPATLSLSPGERATLSCRASQSVSNHMHWYQQKPGQAPRLLIYAASNLESGIPARFSGSGSGTDFTLTISSLEPEDFAVYYCQQSWDDPLTFGQGTKLEIK

SEQ ID NO: 2280 - protein, 107 aa, Artificial Sequence
  Description of Artificial Sequence: Synthetic polypeptide
EIVLTQSPATLSLSPGERVTLSCRASESVSTHMHWYQQKPGQAPRLLIYGASHLESGIPARFSGSGSGTDFTLTISSLEPEDFAVYYCQQSWNDPITFGQGTKLEIK

SEQ ID NO: 2281 - protein, 107 aa, Artificial Sequence
  Description of Artificial Sequence: Synthetic polypeptide
EIVLTQSPATLSLSPGERATLSCRASQSVSNHMHWYQQKPGQAPRLLIYAASNLESGVPARFSGSGSGTDFTLTISSLEPEDFAVYYCQQSWNDPLTFGQGTKLEIK

SEQ ID NO: 2282 - protein, 107 aa, Artificial Sequence
  Description of Artificial Sequence: Synthetic polypeptide
EIVLTQSPATLSLSPGERATLSCRASQSVSSHMHWYQQKPGQAPRLLIYAASKLESGVPARFSGSGSGTDFTLTISSLEPEDFAVYYCQQTWYDPLTFGQGTKLEIK

SEQ ID NO: 2283 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYYCQQSWMDPITFGQGTKLEIK

SEQ ID NO: 2284 - protein, 107 aa, Artificial Sequence
  Description of Artificial Sequence: Synthetic polypeptide
EIVLTQSPATLSLSPGERATLSCRASESVSTNMHWYQQKPGQAPRLLIYGASILESGVPARFSGSGSGTDFTLTISSLEPEDFAVYFCQQSWSEPWTFGQGTKLEIK

SEQ ID NO: 2285 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQSWSDPLTFGQGTKLEIK

SEQ ID NO: 2286 - protein, 107 aa, Artificial Sequence
  Description of Artificial Sequence: Synthetic polypeptide
EIVLTQSPATLSLSPGERATLSCRASQSVDTHMHWYQQKPGQAPRLLIYGASNLESGVPARFSGSGSGTDFTLTISSLEPEDFAVYYCQQSWYDPLTFGQGTKLEIK

SEQ ID NO: 2287 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWNEPFTFGQGTKLEIK

SEQ ID NO: 2288 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASHLESGIPARFSGSGSGTDFTLTISSLEPEDFAVYYCQQSWNDPITFGQGTKLEIK

SEQ ID NO: 2289 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASTLESGVPARFSGSGSGTDFTLTISSLEPEDFAVYYCQQSWNDPLTFGQGTKLEIK

SEQ ID NO: 2290 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASVLESGVPARFSGSGSGTDFTLTISSLEPEDFAVYYCQQSWDDPLTFGQGTKLEIK

SEQ ID NO: 2291 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQTWLDPITFGQGTKLEIK

SEQ ID NO: 2292 - protein, 107 aa, Artificial Sequence
  Description of Artificial Sequence: Synthetic polypeptide
EIVLTQSPATLSLSPGERATLSCRASQSVNTHLAWYQQKPGQAPRLLIYAASHLESGVPARFSGSGSGTDFTLTISSLEPEDFAVYFCQQTWTDPLTFGQGTKLEIK

SEQ ID NO: 2293 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWSDPLTFGQGTKLEIK

SEQ ID NO: 2294 - protein, 107 aa, Artificial Sequence
  Description of Artificial Sequence: Synthetic polypeptide
  MOD_RES (94)..(94): Any amino acid
EIVLTQSPATLSLSPGERATLSCRASQSVSNPMHWYQQKPGQAPRLLIYGASNLESGIPARFSGSGSGTDFTLTISSLEPEDFAVYYCQQSWNXPFTFGQGTKLEIK

SEQ ID NO: 2295 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASKLESGVPARFSGSGSGTDFTLTISSLEPEDFAVYYCQQSWDDPFTFGQGTKLEIK

SEQ ID NO: 2296 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGIPARFSGSGSGTDFTLTISSLEPEDFAVYFCQQTWSDPLTFGQGTKLEIK

SEQ ID NO: 2297 - protein, 107 aa, Artificial Sequence
  Description of Artificial Sequence: Synthetic polypeptide
EIVLTQSPATLSLSPGERATLSCRASESVNSNMHWYQQKPGQAPRLLIYGASHLESGIPARFSGSGSGTDFTLTISSLEPEDFAVYFCQQSWYDPLTFGQGTKLEIK

SEQ ID NO: 2298 - protein, 107 aa, Artificial Sequence
  Description of Artificial Sequence: Synthetic polypeptide
EIVLTQSPATLSLSPGERATLSCRASQSVRNHMHWYQQKPGQAPRLLIYGASNLESGVPARFSGSGSGTDFTLTISSLEPEDFAVYFCQQSWDDPLTFGQGTKLEIK

SEQ ID NO: 2299 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGIPARFSGSGSGTDFTLTISSLEPEDFAVYYCQQSWDDPLTFGQGTKLEIK

SEQ ID NO: 2300 - protein, 107 aa, Artificial Sequence
  Description of Artificial Sequence: Synthetic polypeptide
EIVLTQSPATLSLSPGERATLSCRASQSVNTAMHWYQQKPGQAPRLLIYGASSLESGIPARFSGSGSGTDFTLTISSLEPEDFAVYYCQQSWNDPLTFGQGTKLEIK

SEQ ID NO: 2301 - protein, 107 aa, Artificial Sequence
  Description of Artificial Sequence: Synthetic polypeptide
EIVLTQSPATLSLSPGERATLSCRASESVGSHMHWYQQKPGQAPRLLIYGASHLESGVPARFSGSGSGTDFTLTISSLEPEDFAVYYCQQSWNLPLTFGQGTKLEIK

SEQ ID NO: 2302 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYFCQQSWYDPITFGQGTKLEIK

SEQ ID NO: 2303 - protein, 107 aa, Artificial Sequence
  Description of Artificial Sequence: Synthetic polypeptide
EIVLTQSPATLSLSPGERATLSCRASQSVITHMNWYQQKPGQAPRLLIYGASNLESGVPARFSGSGSGTDFTLTISSLEPEDFAVYYCQQSWGDPWTFGQGTKLEIK

SEQ ID NO: 2304 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYFCQQSWIDPLTFGQGTKLEIK

SEQ ID NO: 2305 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASMLESGIPARFSGSGSGTDFTLTISSLEPEDFAVYYCQQSWDDPLTFGQGTKLEIK

SEQ ID NO: 2306 - protein, 107 aa, Artificial Sequence
  Description of Artificial Sequence: Synthetic polypeptide
EIVLTQSPATLSLSPGERATLSCRASESVSTHMHWYQQKPGQAPRLLIYAASNLESGIPARFSGSGSGTDFTLTISSLEPEDFAVYYCQQSWYDPITFGQGTKLEIK

SEQ ID NO: 2307 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWNDPITFGQGTKLEIK

SEQ ID NO: 2308 - protein, 107 aa, Artificial Sequence
  Description of Artificial Sequence: Synthetic polypeptide
EIVLTQSPATPSLSPGERATLSCRASESVGSCMHWYQQKPGQAPRLLIYGASNLESGIPARFSGSGSGTDFTLTISSLEPEDFAVYFCQQTWYDPLTFGQGTKLEIK

SEQ ID NO: 2309 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYFCQQSWNDPLTFGQGTKLEIK

SEQ ID NO: 2310 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQSWNDPLTFGQGTKLEIK

SEQ ID NO: 2311 - protein, 107 aa, Artificial Sequence
  Description of Artificial Sequence: Synthetic polypeptide
EIVLTQSPATLSLSPGERATLSCRASESVSRHMHWYQQKPGQAPRLLIYGASHLESGVPARFSGSGSGTDFTLTISSLEPEDFAVYYCQQSWNNPLTFGQGTKLEIK

SEQ ID NO: 2312 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQSWNDPATFGQGTKLEIK

SEQ ID NO: 2313 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWNDPLTFGQGTKLEIK

SEQ ID NO: 2314 - protein, 107 aa, Artificial Sequence
  Description of Artificial Sequence: Synthetic polypeptide
EIVLTQSPATLSLSPGERATLSCRASQSVGRHMHWYQQKPGQAPRLLIYGASKLESGVPARFSGSGSGTDFTLTISSLEPEDFAVYYCQQTWTDPLTFGQGTKLEIK

SEQ ID NO: 2315 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQSWSDPITFGQGTKLEIK

SEQ ID NO: 2316 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQSWNDPLTFGQGTKLEIK

SEQ ID NO: 2317 - protein, 107 aa, Artificial Sequence
  Description of Artificial Sequence: Synthetic polypeptide
EIVLTQSPATLSLSPGERATLSCRASESVSSNMNWYQQKPGQAPRLLIYGASNLESGIPARFSGSGSGTDFTLTISSLEPEDFAVYYCQQSFYDPITFGQGTKLEIK

SEQ ID NO: 2318 - protein, 107 aa, Artificial Sequence
  Description of Artificial Sequence: Synthetic polypeptide
EIVLTQSPATLSLSPGERATLSCRASESVSSHMHWYQQKPGQAPRLLIYGASKLESGVPARFSGSGSGTDFTLTISSLEPEDFAVYYCQQSWSDPLTFGQGTKLEIK

SEQ ID NO: 2319 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGVPARFSGSGSGTDFTLTISSLEPEDFAVYYCQQSWHDPLTFGQGTKLEIK

SEQ ID NO: 2320 - protein, 107 aa, Artificial Sequence
  Description of Artificial Sequence: Synthetic polypeptide
EIVLTQSPATLSLSPGERATLSCRASESVSNHMHWYQQKPGQAPRLLIYAASKLESGVPARFSGSGSGTDFTLTISSLEPEDFAVYYCQQTWIDPITFGQGTKLEIK

SEQ ID NO: 2321 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASKLESGVPARFSGSGSGTDFTLTISSLEPEDFAVYYCQQSWTDPLTFGQGTKLEIK

SEQ ID NO: 2322 - protein, 107 aa, Artificial Sequence
  Description of Artificial Sequence: Synthetic polypeptide
EIVLTQSPATLSLSPGERATLSCRASESVRSHLAWYQQKPGQAPRLLIYGASNLESGVPARFSGSGSGTDFTLTISSIEPEDFAVYFCQQSWNAPFTFGQGTKLEIK

SEQ ID NO: 2323 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYFCQQSWSDPLTFGQGTKLEIK

SEQ ID NO: 2324 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGIPARFSGSGSGTDFTLTISSLEPEDFAVYYCQQTWDDPITFGQGTKLEIK

SEQ ID NO: 2325 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYYCQQSWNEPLTFGQGTKLEIK

SEQ ID NO: 2326 - protein, 107 aa, Artificial Sequence
  Description of Artificial Sequence: Synthetic polypeptide
EIVLTQSPATLSLSPGERATLSCRASESVSTHMPWYQQKPGQAPRLLIYGASILESGVPARFSGSGSGTDFTLTISSLEPEDFAVYYCQQSWNDPLTFGQGTKLEIK

SEQ ID NO: 2327 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWSDPLTFGQGTKLEIK

SEQ ID NO: 2328 - protein, 107 aa, Artificial Sequence
  Description of Artificial Sequence: Synthetic polypeptide
EIVLTQSPATLSLSPGERATLSCRASQSVSTAMHWYQQKPGQAPRLLIYGASNLESGIPARFSGSGSGTDFTLTISSLEPEDFAVYYCQQSWFDPLTFGQGTKLEIK

SEQ ID NO: 2329 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASILESGIPARFSGSGSGTDFTLTISSLEPEDFAVYFCQQTWSDPITFGQGTKLEIK

SEQ ID NO: 2330 - protein, 107 aa, Artificial Sequence
  Description of Artificial Sequence: Synthetic polypeptide
EIVLTQSPATLSLSPGERATLSCRASESVNSDMHWYQQKPGQAPRLLIYGASNLESGVPARFSGSGSGTDFTLTISSLEPEDFAVYYCQQSWYDPLTFGQGTKLEIK

SEQ ID NO: 2331 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGIPARFSGSGSGTDFTLTISSLEPEDFAVYYCQQSWNVPITFGQGTKLEIK

SEQ ID NO: 2332 - protein, 107 aa, Artificial Sequence
  Description of Artificial Sequence: Synthetic polypeptide
EIVLTQSPATLSLSPGERATLSCRASESVSTNLAWYQQKPGQAPRLLIYGASKLESGVPARFSGSGSGTDFTLTISSLEPEDFAVYFCQQTWNDPITFGQGTKLEIK

SEQ ID NO: 2333 - protein, 107 aa, Artificial Sequence
  Description of Artificial Sequence: Synthetic polypeptide
EIVLTQSPATLSLSPGERATLSCRASESVSNHMHWYQQKPGQAPRLLIYAASHLESGVPARFSGSGSGTDFTLTISSLEPEDFAVYYCQQSWTDPITFGQGTKLEIK

SEQ ID NO: 2334 - protein, 107 aa, Artificial Sequence
  Description of Artificial Sequence: Synthetic polypeptide
EIVLTQSPATLSLSPGERATLSCRASESVSTHMNWYQQKPGQAPRLLIYGASNLESGVPARFSGSGSGTDFTLTISSLEPEDFAVYYCQQSWTDPITFGQGTKLEIK

SEQ ID NO: 2335 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQTWDVPFTFGQGTKLEIK

SEQ ID NO: 2336 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWSDPITFGQGTKLEIK

SEQ ID NO: 2337 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASHLESGIPARFSGSGSGTDFTLTISSLEPEDFAVYYCQQCRNDPFTFGQGTKLEIK

SEQ ID NO: 2338 - protein, 107 aa, Artificial Sequence
  Description of Artificial Sequence: Synthetic polypeptide
EIVLTQSPATLSLSPGERATLSCRASESVSKHMNWYQQKPGQAPRLLIYGASNLESGVPARFSGSGSGTDFTLTISSLEPEDFAVYYCQQTWTDPLTFGQGTKLEIK

SEQ ID NO: 2339 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASRLESGVPARFSGSGSGTDFTLTISSLEPEDFAVYYCQQSWNDPLTFGQGTKLEIK

SEQ ID NO: 2340 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASHLESGVPARFSGSGSGTDFTLTISSLEPEDFAVYYCQQSWDDPLTFGQGTKLEIK

SEQ ID NO: 2341 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYFCQQSWNEPYTFGQGTKLEIK

SEQ ID NO: 2342 - protein, 107 aa, Artificial Sequence
  Description of Artificial Sequence: Synthetic polypeptide
EIVLTQSPATLSLSPGERATLSCRASESVGMHMHWYQQKPGQAPRLLIYGASNLESGVPARFSGSGSGTDFTLTISSLEPEDFAVYYCQQSWNDPLTFGQGTKLEIK

SEQ ID NO: 2343 - protein, 107 aa, Artificial Sequence
  Description of Artificial Sequence: Synthetic polypeptide
EIVLTQSPATLSLSPGERATLSCRASQSVSTHMNWYQQKPGQAPRLLIYAASNLESGVPARFSGSGSGTDFTLTISSLEPEDFAVYYCQQSFNNPLTFGQGTKLEIK

SEQ ID NO: 2344 - protein, 107 aa, Artificial Sequence
  Description of Artificial Sequence: Synthetic polypeptide
EIVLTQSPATLSLSPGERATLSCRASQSVNTHLHWYQQKPGQAPRLLIYGASNLESGVPARFSGSGSGTDFTLTISSLEPEDFAVYYCQQSWFDPLTFGQGTKLEIK

SEQ ID NO: 2345 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASILESGVPARFSGSGSGTDFTLTISSLEPEDFAVYFCQQSWNDPLTFGQGTKLEIK

SEQ ID NO: 2346 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYFCQQSWYDPLTFGQGTKLEIK

SEQ ID NO: 2347 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQSWLDPLTFGQGTKLEIK

SEQ ID NO: 2348 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASILESGVLARFSGSGSGTDFTLTISSLEPEDFAVYYCQQSWNDPLTFGQGTKLEIK

SEQ ID NO: 2349 - protein, 107 aa, Artificial Sequence
  Description of Artificial Sequence: Synthetic polypeptide
EIVLTQSPATLSLSPGERATLSCRASESVSSHMHWYQQKPGQAPRLLIYGASNLESGIPARFSGSGSGTDFTLTISSLEPEDFAVYYCQQTWNYPITFGQGTKLEIK

SEQ ID NO: 2350 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQTWYDPITFGQGTKLEIK

SEQ ID NO: 2351 - protein, 107 aa, Artificial Sequence
  Description of Artificial Sequence: Synthetic polypeptide
EIVLTQSPATLSLSPGERATLSCRASESVGNHMHWYQQKPGQAPRLLIYGASNLESGIPARFSGSGSGTDFTLTISSLEPEDFAVYYCQQSWIDPLTFGQGTKLEIK

SEQ ID NO: 2352 - protein, 107 aa, Artificial Sequence
  Description of Artificial Sequence: Synthetic polypeptide
EIVLTQSPATLSLSPGERATLSCRASESVSNHMHWYQQKPGQAPRLLIYAASKLESGIPARFSGSGSGTDFTLTISSLEPEDFAVYFCQQSWVEPFTFGQGTKLEIK

SEQ ID NO: 2353 - protein, 107 aa, Artificial Sequence
  Description of Artificial Sequence: Synthetic polypeptide
EIVLTQSPATLSLSPGERATLSCRASQSVETHMHWYQQKPGQAPRLLIYGASHLESGVPARFSGSGSGTDFTLTISSLEPEDFAVYYCQQSWRDPLTFGQGTKLEIK

SEQ ID NO: 2354 - protein, 107 aa, Artificial Sequence
  Description of Artificial Sequence: Synthetic polypeptide
EIVLTQSPATLSLSPGERATLSCRASQSVSTHMNWYQQKPGQAPRLLIYGASHLESGIPARFSGSGSGTDFTLTISSLEPEDFAVYFCQQSWDDPLTFGQGTKLEIK

SEQ ID NO: 2355 - protein, 107 aa, Artificial Sequence
  Description of Artificial Sequence: Synthetic polypeptide
EIVLTQSPATLSLSPGERATLSCRASQSVGSSMHWYQQKPGQAPRLLIYGASKLESGVPARFSGSGSGTDFTLTISSLEPEDFAVYFCQQSWNDPLTFGQGTKLEIK

SEQ ID NO: 2356 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQSWNDPLTFGQGTKLEIK

SEQ ID NO: 2357 - protein, 107 aa, Artificial Sequence
  Description of Artificial Sequence: Synthetic polypeptide
EIVLTQSPATLSLSPGERATLSCRASQSVTNHMHWYQQKPGQAPRLLIYGASNLESGVPARFSGSGSGTDFTLTISSLEPEDFAVYYCQQSWHDPLTFGQGTKLEIK

SEQ ID NO: 2358 - protein, 107 aa, Artificial Sequence
  Description of Artificial Sequence: Synthetic polypeptide
EIVLTQSPATLSLSPGERATLSCRASESVSSHLAWYQQKPGQAPRLLIYGASTLESGIPARFSGSGSGTDFTLTISSLEPEDFAVYYCQQSWGDPFTFGQGTKLEIK

SEQ ID NO: 2359 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGIPARFSGSGSGTDFTLTISSLEPEDFAVYYCQQSWSDPLTFGQGTKLEIK

SEQ ID NO: 2360 - protein, 107 aa, Artificial Sequence
  Description of Artificial Sequence: Synthetic polypeptide
EIVLTQSPATLSLSPGERATLSCRASESVHDHMHWYQQKPGQAPRLLIYAASHLESGVPARFSGSGSGTDFTLTISSLEPEDFAVYYCQQSWNDPLTFGQGTKLEIK

SEQ ID NO: 2361 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWADPLTFGQGTKLEIK

SEQ ID NO: 2362 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASILESGIPARFSGSGSGTDFTLTISSLEPEDFAVYYCQQSWYDPLTFGQGTKLEIK

SEQ ID NO: 2363 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGVPARFSGSGSGTDFTLTISSLEPEDFAVYYCQQSWNDPFTFGQGTKLEIK

SEQ ID NO: 2364 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYYCQQSFYDPLTFGQGTKLEIK

SEQ ID NO: 2365 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYYCQQSWYDPLTFGQGTKLEIK

SEQ ID NO: 2366 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASMLESGIPARFSGSGSGTDFTLTISSLEPEDFAVYYCQQSWMDPITFGQGTKLEIK

SEQ ID NO: 2367 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWMDPLTFGQGTKLEIK

SEQ ID NO: 2368 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASILESGIPARFSGSGSGTDFTLTISSLEPEDFAVYYCQQSWYDPLTFGQGTKLEIK

SEQ ID NO: 2369 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYYCQQSWHDPLTFGQGTKLEIK

SEQ ID NO: 2370 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSFTNPLTFGQGTKLEIK

SEQ ID NO: 2371 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQSWYDPLTFGQGTKLEIK

SEQ ID NO: 2372 - protein, 107 aa, Artificial Sequence
  Description of Artificial Sequence: Synthetic polypeptide
  MOD_RES (27)..(27): Any amino acid
  MOD_RES (53)..(53): Any amino acid
  MOD_RES (91)..(91): Any amino acid
EIVLTQSPATLSLSPGERATLSCRASXSVNTHMHWYQQKPGQAPRLLIYGASXLESGVPARFSGSGSGTDFTLTISSLEPEDFAVYFCQQXWYDPITFGQGTKLEIK

SEQ ID NO: 2373 - protein, 107 aa, Artificial Sequence
  Description of Artificial Sequence: Synthetic polypeptide
EIVLTQSPATLSLSPGERATLSCRASESVRTHMHWYQQKPGQAPRLLIYGASNLESGVPARFSGSGSGTDFTLTISSLEPEDFAVYYCQQSWYDPLTFGQGTKLEIK

SEQ ID NO: 2374 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGVPARFSGSGSGTDFTLTISSLEPEDFAVYYCQQTWYDPLTFGQGTKLEIK

SEQ ID NO: 2375 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGVPARFSGSGSGTDFTLTISSLEPEDFAVYYCQQSWYDPLTFGQGTKLEIK

SEQ ID NO: 2376 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASHLESGIPARFSGSGSGTDFTLTISSLEPEDFAVYYCQQSWYDPLTFGQGTKLEIK

SEQ ID NO: 2377 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASVLESGVPARFSGSGSGTDFTLTISSLEPEDFAVYYCQQSWYDPLTFGQGTKLEIK

SEQ ID NO: 2378 - protein, 107 aa, Artificial Sequence
  Description of Artificial Sequence: Synthetic polypeptide
EIVLTQSPATLSLSPGERATLSCRASQSVSRHMHWYQQKPGQAPRLLIYGASNLESGIPARFSGSGSGTDFTLTISSLEPEDFAVYYCQQSWYDPITFGQGTKLEIK

SEQ ID NO: 2379 - protein, 107 aa, Artificial Sequence
  Description of Artificial Sequence: Synthetic polypeptide
EIVLTQSPATLSLSPGERATLSCRASQSVSSHMHWYQQKPGQAPRLLIYGASILESGIPARFSGSGSGTDFTLTISSLEPEDFAVYYCQQTWDDPITFGQGTKLEIK

SEQ ID NO: 2380 - protein, 107 aa, Artificial Sequence
  Description of Artificial Sequence: Synthetic polypeptide
EIVLTQSPATLSLSPGERATLSCRASESVSTSMHWYQQKPGQAPRLLIYGASQLESGVPARFSGSGSGTDFTLTISSLEPEDFAVYYCQQSWNVPFTFGQGTKLEIK

SEQ ID NO: 2381 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASRLESGIPARFSGSGSGTDFTLTISSLEPEDFAVYYCQQSWTVPLTFGQGTKLEIK

SEQ ID NO: 2382 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASHLESGVPARFSGSGSGTDFTLTISSLEPEDFAVYYCQQTWYDPLTFGQGTKLEIK

SEQ ID NO: 2383 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASVLESGVPARFSGSGSGTDFTLTISSLEPEDFAVYFCQQSWYDPLTFGQGTKLEIK

SEQ ID NO: 2384 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASTLESGIPARFSGSGSGTDFTLTISSLEPEDFAVYFCQQSWYDPLTFGQGTKLEIK

SEQ ID NO: 2385 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASYLESGVPARFSGSGSGTDFTLTISSLEPEDFAVYFCQQTWYDPLTFGQGTKLEIK

SEQ ID NO: 2386 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASTLESGVPARFSGSGSGTDFTLTISSLEPEDFAVYYCQQTWYDPLTFGQGTKLEIK

SEQ ID NO: 2387 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASILESGVPARFSGSGSGTDFTLTISSLEPEDFAVYYCQQSWYDPLTFGQGTKLEIK

SEQ ID NO: 2388 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASNLESGVPARFSGSGSGTDFTLTISSLEPEDFAVYYCQQSWYDPLTFGQGTKLEIK

SEQ ID NO: 2389 - protein, 107 aa, Artificial Sequence
  Description of Artificial Sequence: Synthetic polypeptide
EIVLTQSPATLSLSPGERATLSCRASQSVGEHMHWYQQKPGQAPRLLIYGASHLESGVPARFSGSGSGTDFTLTISSLEPEDFAVYYCQQSWYDPITFGQGTKLEIK

SEQ ID NO: 2390 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASHLESGVPARFSGSGSGTDFTLTISSLEPEDFAVYYCQQTWYDPLTFGQGTKLEIK

SEQ ID NO: 2391 - protein, 107 aa, Artificial Sequence
  Description of Artificial Sequence: Synthetic polypeptide
EIVLTQSPATLSLSPGERATLSCRASQSVSTNMHWYQQKPGQAPRLLIYGASILESGVPARFSGSGSGTDFTLTISSLEPEDFAVYFCQQTWYDPITFGQGTKLEIK

SEQ ID NO: 2392 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASTLESGIPARFSGSGSGTDFTLTISSLEPEDFAVYYCQQSWYDPLTFGQGTKLEIK

SEQ ID NO: 2393 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYFCQQSWYDPLTFGQGTKLEIK

SEQ ID NO: 2394 - protein, 107 aa, Artificial Sequence
  Description of Artificial Sequence: Synthetic polypeptide
EIVLTQSPATLSLSPGERATLSCRASQSVGSHMHWYQQKPGQAPRLLIYGASILESGVPARFSGSGSGTDFTLTISSLEPEDFAVYFCQQSWYDPITFGQGTKLEIK

SEQ ID NO: 2395 - protein, 107 aa, Artificial Sequence
  Description of Artificial Sequence: Synthetic polypeptide
EIVLTQSPATLSLSPGERATLSCRASQSVGNHMHWYQQKPGQAPRLLIYGASNLESGVPARFSGSGSGTDFTLTISSLEPEDFAVYFCQQSWYDPLTFGQGTKLEIK

SEQ ID NO: 2396 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYYCQQTWYDPLTFGQGTKLEIK

SEQ ID NO: 2397 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQSWYDPITFGQGTKLEIK

SEQ ID NO: 2398 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASHLESGIPARFSGSGSGTDFTLTISSLEPEDFAVYYCQQSWYDPITFGQGTKLEIK

SEQ ID NO: 2399 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASKLESGVPARFSGSGSGTDFTLTISSLEPEDFAVYYCQQSWYDPLTFGQGTKLEIK

SEQ ID NO: 2400 - protein, 107 aa, Artificial Sequence
  Description of Artificial Sequence: Synthetic polypeptide
EIVLTQSPATLSLSPGERATLSCRASESVSRHMNWYQQKPGQAPRLLIYGASNLESGIPARFSGSGSGTDFTLTISSLEPEDFAVYFCQQTWYDPITFGQGTNLEIK

SEQ ID NO: 2401 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASYLESGIPARFSGSGSGTDFTLTISSLEPEDFAVYYCQQTWYDPITFGQGTKLEIK

SEQ ID NO: 2402 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGVPARFSGSGSGTDFTLTISSLEPEDFAVYFCQQSWYDPITFGQGTKLEIK

SEQ ID NO: 2403 - protein, 107 aa, Artificial Sequence
  Description of Artificial Sequence: Synthetic polypeptide
EIVLTQSPATLSLSPGERATLSCRASESVDTHMHWYQQKPGQAPRLLIYGASNLESGVPARFSGSGSGTDFTLTISSLEPEDFAVYYCQQSWYDPLTFGQGTKLEIK

SEQ ID NO: 2404 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWYDPITFGQGTKLEIK

SEQ ID NO: 2405 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQSWYDPLTFGQGTKLEIK

SEQ ID NO: 2406 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGVPARFSGSGSGTDFTLTISSLEPEDFAVYYCQQSWYDPLTFGQGTKLEIK

SEQ ID NO: 2407 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGIPARFSGSGSGTDFTLTISSLEPEDFAVYYCQQSWYDPLTFGQGTKLEIK

SEQ ID NO: 2408 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQTWYDPITFGQGTKLEIK

SEQ ID NO: 2409 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGVPARFSGSGSGTDFTLTISSLEPEDFAVYYCQQSWYDPLTFGQGTKLEIK

SEQ ID NO: 2410 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASILESGIPARFSGSGSGTDFTLTISSLEPEDFAVYFCQQSWYDPLTFGQGTKLEIK

SEQ ID NO: 2411 - protein, 107 aa, Artificial Sequence
  Description of Artificial Sequence: Synthetic polypeptide
EIVLTQSPATLSLSPGERATLSCRASESVDRHMHWYQQKPGQAPRLLIYGASHLESGVPARFSGSGSGTDFTLTISSLEPEDFAVYYCQQTWYDPLTFGQGTKLEIK

SEQ ID NO: 2412 - protein, 107 aa, Artificial Sequence
  Description of Artificial Sequence: Synthetic polypeptide
EIVLTQSPATLSLSPGERATLSCRASQSVTNHMHWYQQKPGQAPRLLIYGASVLESGIPARFSGSGSGTDFTLTISSLEPEDFAVYYCQQSWYDPLTFGQGTKLEIK

SEQ ID NO: 2413 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYYCQQSWYDPITFGQGTKLEIK

SEQ ID NO: 2414 - protein, 107 aa, Artificial Sequence
  Description of Artificial Sequence: Synthetic polypeptide
EIVLTQSPATLSLSPGERATLSCRASESVSNHMHWYQQKPGQAPRLLIYGASNLESGVPARFSGSGSGTDFTLTISSLEPEDFAVYYCQQTWYDPITFGQGTKLEIK

SEQ ID NO: 2415 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQTWYDPLTFGQGTKLEIK

SEQ ID NO: 2416 - protein, 107 aa, Artificial Sequence
  Description of Artificial Sequence: Synthetic polypeptide
  MOD_RES (14)..(14): Any amino acid
EIVLTQSPATLYLXPGERATLSCRASQSVSTHMHWYQQKPGQAARLVMYGASNLEFGVPARFSGSGSGTEFTLTISSLEPEDFAVYYCQQSWYDPLTFGQGTKLEIK

SEQ ID NO: 2417 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWYDPITFGQGTKLEIK

SEQ ID NO: 2418 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASHLESGIPARFSGSGSGTDFTLTISSLEPEDFAVYYCQQSWYDPLTFGQGTKLEIK

SEQ ID NO: 2419 - protein, 107 aa, Artificial Sequence
  Description of Artificial Sequence: Synthetic polypeptide
EIVLTQSPATLSLSPGERATLSCRASQSVGAHMHWYQQKPGQAPRLLIYGASNLESGVPARFSGSGSGTDFTLTISSLEPEDFAVYYCQQTWYDPLTFGQGTKLEIK

SEQ ID NO: 2420 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWSDPLTFGQGTKLEIK

SEQ ID NO: 2421 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGIPARFSGSGSGTDFTLTISSLEPEDFAVYYCQQSWYDPITFGQGTKLEIK

SEQ ID NO: 2422 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASHLESGVPARFSGSGSGTDFTLTISSLEPEDFAVYYCQQSWYDPLTFGQGTKLEIK

SEQ ID NO: 2423 - protein, 107 aa, Artificial Sequence
  Description of Artificial Sequence: Synthetic polypeptide
  MOD_RES (31)..(31): Any amino acid
EIVLTQSPATLSLSPGERATLSCRASESVSXHMHWYQQKPGQAPRLLIYGASILESGVPARFSGSGSGTDFTLTISSLEPEDFAVYYCQQSWYDPLTFGQGTKLEIK

SEQ ID NO: 2424 - protein, 107 aa, Artificial Sequence
  Description of Artificial Sequence: Synthetic polypeptide
EIVLTQSPATLSLSPGERATLSCRASESVSTAMHWYQQKPGQAPRLLIYAASILESGVPARFSGSGSGTDFTLTISSLEPEDFAVYYCQQSWYDPLTFGQGTKLEIK

SEQ ID NO: 2425 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASYLESGVPARFSGSGSGTDFTLTISSLEPEDFAVYYCQQTWYDPITFGQGTKLEIK

SEQ ID NO: 2426 - protein, 107 aa, Artificial Sequence
  Description of Artificial Sequence: Synthetic polypeptide
EIVLTQSPATLSLSPGERATLSCRASQSVGSHMHWYQQKPGQAPRLLIYGASNLESGIPARFSGSGSGTDFTLTISSLEPEDFAVYYCQQTWYDPLTFGQGTKLEIK

SEQ ID NO: 2427 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYFCQQSWYDPLTFGQGTKLEIK

SEQ ID NO: 2428 - protein, 107 aa, Artificial Sequence
  Description of Artificial Sequence: Synthetic polypeptide
EIVLTQSPATLSLSPGERATLSCRASQSVGTNMHWYQQKPGQAPRLLIYGASVLESGIPARFSGSGSGTDFTLTISSLEPEDFAVYFCQQTWYDPITFGQGTKLEIK

SEQ ID NO: 2429 - protein, 107 aa, Artificial Sequence
  Description of Artificial Sequence: Synthetic polypeptide
EIVLTQSPATLSLSPGERATLSCRASESVGKHMHWYQQKPGQAPRLLIYGASHLESGVPARFSGSGSGTDFTLTISSLEPEDFAVYYCQQSWMDPLTFGQGTKLEIK

SEQ ID NO: 2430 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASFLESGVPARFSGSGSGTDFTLTISSLEPEDFAVYYCQQSWYDPLTFGQGTKLEIK

SEQ ID NO: 2431 - protein, 107 aa, Artificial Sequence
  Description of Artificial Sequence: Synthetic polypeptide
EIVLTQSPATLSLSPGERATLSCRASESVGTHMHWYQQKPGQAPRLLIYGASNLESGIPARFSGSGSGTDFTLTISSLEPEDFAVYYCQQSWGDPLTFGQGTKLEIK

SEQ ID NO: 2432 - protein, 107 aa, Artificial Sequence
  Description of Artificial Sequence: Synthetic polypeptide
EIVLTQSPATLSLSPGERATLSCRASESVSKHMHWYQQKPGQAPRLLIYGASHLESGIPARFSGSGSGTDFTLTISSLEPEDFAVYYCQQSWYDPLTFGQGTKLEIK

SEQ ID NO: 2433 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASMLESGIPARFSGSGSGTDFTLTISSLEPEDFAVYYCQQTWDDPLTFGQGTKLEIK

SEQ ID NO: 2434 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGIPARFSGSGSGTDFTLTISSLEPEDFAVYYCQQSWYDPLTFGQGTKLEIK

SEQ ID NO: 2435 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWYDPLTFGQGTKLEIK

SEQ ID NO: 2436 - protein, 107 aa, Artificial Sequence
  Description of Artificial Sequence: Synthetic polypeptide
  MOD_RES (30)..(31): Any amino acid
  MOD_RES (96)..(96): Any amino acid
EIVLTQSPATLSLSPGERATLSCRASQSVXXHMHWYQQKPGQAPRLLIYGASTLESGVPARFSGSGSGTDFTLTISSLEPEDFAVYYCQQTWTDPXTFGQGTKLEIK

SEQ ID NO: 2437 - protein, 107 aa, Artificial Sequence
  Description of Artificial Sequence: Synthetic polypeptide
EIVLTQSPATLSLSPGERATLSCRASESVSTHLHWYQQKPGQAPRLLIYGASILESGIPARFSGSGSGTDFTLTISSLEPEDFAVYYCQQSWYDPLTFGQGTKLEIK

SEQ ID NO: 2438 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYYCQQSWYDPLTFGQGTKLEIK

SEQ ID NO: 2439 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASNLESGIPARFSGSGSGTDFTLTISSLEPEDFAVYYCQQTWYDPITFGQGTKLEIK

SEQ ID NO: 2440 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGIPARFSGSGSGTDFTLTISSLEPEDFAVYYCQQSWYDPITFGQGTKLEIK

SEQ ID NO: 2441 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASMLESGIPARFSGSGSGTDFTLTISSLEPEDFAVYYCQQSWYDPLTFGQGTKLEIK

SEQ ID NO: 2442 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQTWYDPITFGQGTKLEIK

SEQ ID NO: 2443 - protein, 107 aa, Artificial Sequence
  Description of Artificial Sequence: Synthetic polypeptide
EIVLTQSPATLSLSPGERATLSCRASQSVSNHMHWYQQKPGQAPRLLIYGASNLESGVPARFSGSGSGTDFTLTISSLEPEDFAVYYCQQSWIEPYTFGQGTKLEIK

SEQ ID NO: 2444 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQTWYDPITFGQGTKLEIK

SEQ ID NO: 2445 - protein, 107 aa, Artificial Sequence
  Description of Artificial Sequence: Synthetic polypeptide
EIVLTQSPATLSLSPGERATLSCRASESVNTHMHWYQQKPGQAPRLLIYGASILESGVPARFSGSGSGTDFTLTISSLEPEDFAVYYCQQSWNDPFTFGQGTKLEIK

SEQ ID NO: 2446 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASILESGIPARFSGSGSGTDFTLTISSLEPEDFAVYFCQQSWYDPLTFGQGTKLEIK

SEQ ID NO: 2447 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASILESGVPARFSGSGSGTDFTLTISSLEPEDFAVYFCQQSWYDPGTFGQGTKLEIK

SEQ ID NO: 2448 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASNLESGIPARFSGSGSGTDFTLTISSLEPEDFAVYYCQQSWYDPLTFGQGTKLEIK

SEQ ID NO: 2449 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQTWYDPLTFGQGTKLEIK

SEQ ID NO: 2450 - protein, 107 aa, Artificial Sequence
  Description of Artificial Sequence: Synthetic polypeptide
  MOD_RES (87)..(87): Any amino acid
EIVLTQSPATLSLSPGERATLSCRASQSVGTHMQWYQQKPGQAPRLLIYGASILESGIPARFSGSGSGTDFTLTISSLEHEDFAVYXCQQSWYDPLTFGQGTKLEIK

SEQ ID NO: 2451 - protein, 107 aa, Artificial Sequence
  Description of Artificial Sequence: Synthetic polypeptide
EIVLTQSPATLSLSPGERATLSCRASESVGRHMHWYQQKPGQAPRLLIYGASNLESGIPARFSGSGSGTDFTLTISSLEPEDFAVYFCQQTWYDPITFGQGTKLEIK

SEQ ID NO: 2452 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASYLESGVPARFSGSGSGTDFTLTISSLEPEDFAVYFCQQSWYDPLTFGQGTKLEIK

SEQ ID NO: 2453 - protein, 107 aa, Artificial Sequence
  Description of Artificial Sequence: Synthetic polypeptide
EIVLTQSPATLSLSPGERATLSCRASESVDSSMHWYQQKPGQAPRLLIYGASILESGVPARFSGSGSGTDFTLTISSLEPEDFAVYYCQQTWYDPLTFGQGTKLEIK

SEQ ID NO: 2454 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASILESGVPARFSGSGSGTDFTLTISSLEPEDFAVYYCQQTWYDPITFGQGTKLEIK

SEQ ID NO: 2455 - protein, 107 aa, Artificial Sequence
  Description of Artificial Sequence: Synthetic polypeptide
EIVLTQSPATLSLSPGERAALSCRASQSVSTHMHWYQQKPGQAPRLLIYGASNLESGIPARFSGSGSGTDFTLTISSLEPEDFAVYYCQQSWYDPLTFGQGTKLEIK

SEQ ID NO: 2456 - protein, 107 aa, Artificial Sequence
  Description of Artificial Sequence: Synthetic polypeptide
EIVLTQSPATLSLSPGERATLSYRASQSVGTHMHWYQQKPGQAPRLLIYGASHLESGIPARFSGSGSGTDFTLTISSLEPEDFAVYYCQQTWYDPLTFGQGTKLEIK

SEQ ID NO: 2457 - protein, 107 aa, Artificial Sequence
  Description of Artificial Sequence: Synthetic polypeptide
EIVLTQSPGTLSLSPGERATLSCRASQSVGTHMHWYQQKPGQAPRLLIYGASKLESGVPARFSGSGSGTDFTLTISSLEPEDFAVYYCQQSWYDPLTFGQGTKLEIK

SEQ ID NO: 2458 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGADFTLTISSLEPEDFAVYYCQQSWYDPLTFGQGTKLEIK

SEQ ID NO: 2459 - protein, 107 aa, Artificial Sequence
  Description of Artificial Sequence: Synthetic polypeptide
EIVLTQSPGTLSLSPGERATLSCRASESVSTHMHWYQQKPGQAPRLLIYGASNLESGVPARFSGSGSGTDFTLTISSLEPEDFAVYYCQQSWYDPLTFGQGTKLEIK

SEQ ID NO: 2460 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASHPESGIPARFSGSGSGTDFTLTISSLEPEDFAVYYCQQTWYDPLTFGQGTKLEIK

SEQ ID NO: 2461 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQSWYDPMTFGQGTKLEIK

SEQ ID NO: 2462 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLGSN

SEQ ID NO: 2463 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASKLESGVPARFSGSGSGTDFTLTISSLEPEDFAVYYCQQSWYDPLTFGQGTKLRSN

SEQ ID NO: 2464 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGIPARFSGSGSGTDFTLTISSLEPEDFAVYFCQQSWYDPMTFGQGTKLEIK

SEQ ID NO: 2465 - protein, 107 aa, Artificial Sequence
  Description of Artificial Sequence: Synthetic polypeptide
EIVLTQSPATLSLSPGERAILSCRASQSVGTHMHWYQQKPGQAPRLLIYGASKLESGVPARFSGSGSGTDFTLTISSLEPEDFAVYYCQQSWYDPLAFGQGTKLEIK

SEQ ID NO: 2466 - protein, 107 aa, Artificial Sequence
  Description of Artificial Sequence: Synthetic polypeptide
EIVLPQSPATLSLSPGERATLSCRASESVSTHMHWYQQKPGQAPRLLIYGASNLEPGVPARFSGSGSGTDFTLTISSLEPEDFAVYFCQQSWNDPFTFGQGTKLEIK

SEQ ID NO: 2467 - protein, 107 aa, Artificial Sequence
  Description of Artificial Sequence: Synthetic polypeptide
EIVLTQSPGTLSLSPGERATLSCRASESVSTHMHWYQQKPGQAPRLLIYGASNLESGVPARFSGSGSGTDFTLTISSLEPEDFAVYFCQQSWNDPFTFGQGTKLEIK

SEQ ID NO: 2468 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGVPARFSGSGSGTDFTLTISSLEPEDFAVYYCQQSWYDPLTFGQGTKLEIK

SEQ ID NO: 2469 - protein, 107 aa, Artificial Sequence
  Description of Artificial Sequence: Synthetic polypeptide
RNCVTQSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK

SEQ ID NO: 2470 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASKLESGVPARFSGSGSGTDFTLTISSLEPEDFAVYYCQQSWCDPLTFGQGTKLEIK

SEQ ID NO: 2471 - protein, 107 aa, Artificial Sequence
  Description of Artificial Sequence: Synthetic polypeptide
EIVLTQSPATLSLSPGERATLSCRASQSVSTHMHWYQQKPGQAPRLPIYGASNLESGVPARFSGSGSGTDFTLTISSLEPEDFAVYYCQQSWYDPLTFGQGTKLEIK

SEQ ID NO: 2472 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASKLESGVPARFSGSGSGTDFTLTISSLGPEDFAVYYCQQSWYDPLTFGQGTKLEIK

SEQ ID NO: 2473 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK

SEQ ID NO: 2474 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQSWYDPMTFGQGTKLEIK

SEQ ID NO: 2475 - protein, 107 aa, Artificial Sequence
  Description of Artificial Sequence: Synthetic polypeptide
EIVLTQSPGTLSLSPGERATLSCRASESVSTHMHWYQQKPGQAPRLLIYGASKLESGVPARFSGSGSGTDFTLTISSLEPEDFAVYYCQQSWYDPLTFGQGTKLEIK

SEQ ID NO: 2476 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWYDPLTFGQRTKLEIK

SEQ ID NO: 2477 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQSWYDPMAFGQGTKLEIK

SEQ ID NO: 2478 - protein, 107 aa, Artificial Sequence
  Description of Artificial Sequence: Synthetic polypeptide
RNCVDKSPATLSLSPGERATLSCRASQSVGTHMHWYQQKPGQAPRLLIYGASHLESGIPARFSGSGSGTDFTLTISSLEPEDFAVYYCQQTWYDPLTFGQGTKLEIK

SEQ ID NO: 2479 - protein, 107 aa, Artificial Sequence
  Description of Artificial Sequence: Synthetic polypeptide
EIVLTQSPATLSLSPGERATLSCRASQSVGTHMHWYQQKPGQAPRLLIYGASKLESGVPARFSGSGSGTDFTLTISSLEPEDFAVYYCQQSWYDPLTFGQGTKLEIK

SEQ ID NO: 2480 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQRSWYDPLTFGQGTKLEIK

SEQ ID NO: 2481 - protein, 107 aa, Artificial Sequence
  Description of Artificial Sequence: Synthetic polypeptide
EIVLTQSPATLSLSPGERATLSCRASESVSTHMHWYQQKPGQAPRLLIYGASNLESGVPARFSGSGSGTDFTLTISSLEPEDFAVYFCQQSWNDPFTFGQGTKLEIK

SEQ ID NO: 2482 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQSWYDPLTFGQGTKLEIK

SEQ ID NO: 2483 - protein, 107 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFVVYYCQQSWYDPITFGQGTKLEIK

SEQ ID NO: 2484 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYFCQQTCYDPLTFGQGTKLEIK

SEQ ID NO: 2485 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGADFTLTISSLEPEDFAVYFCQQSWYDPLTFGQGTKLEIK

SEQ ID NO: 2486 - protein, 107 aa, Artificial Sequence
  Description of Artificial Sequence: Synthetic polypeptide
EIVLTQSPATLSLSPGERATLSCRASESVGKHMHWYQQKPGQAPRLLIYGASNLESGIPARFSGSGSGTDFTLTISSLEPEDFAVYFCQQTWYDPITFGQGTKLEIK

SEQ ID NO: 2487 - protein, 107 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQTWYDPLTFGQGTKLEIK

SEQ ID NO: 2488 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGIPARFSGSGSGTDFTLTISSLEPEDFAVYYCQQSFYDPLTFGQGTKLEIK

SEQ ID NO: 2489 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASILESGVPARFSGSGSGTDFTLTISSLEPEDFAVYFCQQTWYDPLTFGQGTKLEIK

SEQ ID NO: 2490 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFILTISSLEPEDFAVYYCQQSFYDPLTFGQGTKLEIK

SEQ ID NO: 2491 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGIPARFSGSGSGTDFTLTISSLEPEDFAVYFCQQSWYDPLTFGQGTKLEIK

SEQ ID NO: 2492 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASILESGVPARFSGSGSGTDFTLTISSLEPEDFAIYFCQQTWYDPLTFGQGTKLEIK

SEQ ID NO: 2493 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGIDFTLTISSLEPEDFAVYFCQQTWYDPLTFGQGTKLEIK

SEQ ID NO: 2494 - protein, 107 aa, Artificial Sequence
  Description of Artificial Sequence: Synthetic polypeptide
EIVLTQSPATLSLSPGERATLSCRASGSVGKHMHWYQQKPGQAPRLLIYAASNLESGVPARFSGSGSGTDFTLTISSLEPEDFAVYYCQQSWYDPLTFGQGTKLEIK

SEQ ID NO: 2495 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASILESGVPARFSGSGSGTDFTLTISSLEPEEFAVYFCQQTWYDPLTFGQGTKLEIK

SEQ ID NO: 2496 - protein, 107 aa, Artificial Sequence
  Description of Artificial Sequence: Synthetic polypeptide
EIVLTQSPATLSLSPGERATLSCRASQSVSKHMHWYQQKPGQAPRLLIYGASNLESGIPARFSGSGSGTDSTLTISSLEPEDFAVYFCQQTWYDPITFGQGTKLEIK

SEQ ID NO: 2497 - protein, 107 aa, Artificial Sequence
  Description of Artificial Sequence: Synthetic polypeptide
EIVLTQSPATLSLPPGERATLSCRASQSVSTHMHWYQQKPGQAPRLLIYGASNLESGIPARFSGSGSGTDFTLTISSLEPEDFAVYYCQQSFYDPLTFGQGTKLEIK

SEQ ID NO: 2498 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFGGSGSGTDFTLTISSLEPEDFAVYYCQQSFYDPLTFGQGTKLEIK

SEQ ID NO: 2499 - protein, 107 aa, Artificial Sequence
  Description of Artificial Sequence: Synthetic polypeptide
EIVSTQSPATLSLSPGERATLSCRASQSVSTHMHWYQQKPGQAPRLLIYGASNLESGIPARFSGSGSGTDFTLTIGSLEPEDFAVYFCQQSWYDPLTFGQGTKLEIK

SEQ ID NO: 2500 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTNLEIK

SEQ ID NO: 2501 - protein, 107 aa, Artificial Sequence
  Description of Artificial Sequence: Synthetic polypeptide
EIVLTQSPATLSLSPGERATFSCRASQSVSTHMHWYQQKPGQAPRLLIYGASKLESGVPARFSGSGSGTDFTLTISSLEPEDFAVYYCQQSWYDPLTFGQGTKLEIK

SEQ ID NO: 2502 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAAYFCQQTWYDPLTFGQGTKLEIK

SEQ ID NO: 2503 - protein, 107 aa, Artificial Sequence
  Description of Artificial Sequence: Synthetic polypeptide
EIVLTQSPSTLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK

SEQ ID NO: 2504 - protein, 107 aa, Artificial Sequence
  Description of Artificial Sequence: Synthetic polypeptide
  MOD_RES (107)..(107): Any amino acid
EIVLTQSPATLSLSPGERATLSCRASQSVNNHMHWYQQKPGQAPRLLIYGASILESGVPARFSGSGSGTDFTLTISSLEPEDFAVYFCQQSWYDPLTFGQGTKLEIX

SEQ ID NO: 2505 - protein, 107 aa, Artificial Sequence
  Description of Artificial Sequence: Synthetic polypeptide
EIVLTQSPATLSLSPGERATLSCRASQSVSTHMHWCQQKPGQAPRLLIYGASNLESGVPARFSGSGSGTDFTLTISSLEPEDFAVYFCQQTWYDPLTFGQGTKLEIK

SEQ ID NO: 2506 - protein, 107 aa, Artificial Sequence
  Description of Artificial Sequence: Synthetic polypeptide
EIVLTQSPGTLSLSPGERATLSCRASQSVNNHMHWYQQKPGQAPRLLIYGASILESGVPARFSGSGSGTDFTLTISSLEPEDFAVYFCQQSWYDPLTFGQGTKLEIK

SEQ ID NO: 2507 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYFCQQSWYDPLTFGQGTKLEIK

SEQ ID NO: 2508 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGVPARFSGSGSGTDFTLTISSLEPEDFAVYFCQQSWYDPLTFGQGTKLEIK

SEQ ID NO: 2509 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASILESGVPARFSGSGSGTDFTLTISSLEPEDFAVYYCQQSWYDPLTFGQGTKLEIK

SEQ ID NO: 2510 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASKLESGVPARFSGSGSGTDFTLTISSLEPEDFAVYYCQQSWYDPLTFGQGTKLRSN

SEQ ID NO: 2511 - protein, 107 aa, Artificial Sequence
  Description of Artificial Sequence: Synthetic polypeptide
EIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLRSN

SEQ ID NO: 2512 - protein, 107 aa, Artificial Sequence
  Description of Artificial Sequence: Synthetic polypeptide
EIVLTQSPGTLSLSPGERATLSCRASQSVSTHMHWYQQEPGQAPRLLIYGASKLESGVPARFSGSGSGTDFTLTISSLEPEDFAVYYCQQSWYDPLTFGQGTKLEIK

SEQ ID NO: 2513 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK

SEQ ID NO: 2514 - protein, 107 aa, Artificial Sequence
  Description of Artificial Sequence: Synthetic polypeptide
RNLLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK

SEQ ID NO: 2515 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLVIK

SEQ ID NO: 2516 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGADFTLTISSLEPEDFAVYFCQQTWYDPLTFGQGTKLEIK

SEQ ID NO: 2517 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASILESGVPARFSGSGSGTDFTLTISSLEPEDFAVYFCQQSRYDPLTFGQGTKLEIK

SEQ ID NO: 2518 - protein, 107 aa, Artificial Sequence
  Description of Artificial Sequence: Synthetic polypeptide
EIVLTQSPGTLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK

SEQ ID NO: 2519 - protein, 107 aa, Artificial Sequence
  Description of Artificial Sequence: Synthetic polypeptide
EIVLTQSPGTLSLSPGERATLSCRASQSVATHMHWYQQKPGQAPRLLIYGASNLESGVPARFSGSGSGTDFTLTISSLEPEDFAVYYCQQSWYDPLTFGQGTKLEIK

SEQ ID NO: 2520 - protein, 107 aa, Artificial Sequence
  Description of Artificial Sequence: Synthetic polypeptide
AIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLEIK

SEQ ID NO: 2521 - protein, 107 aa, Artificial Sequence
  Description of Artificial Sequence: Synthetic polypeptide
EIVLTQSPAALSLSPGERATLSCRASQSVSTHMHWYQQKPGQAPRLLIYGASNLESGVPARFSGSGSGTDFTLTISSLEPEDFAVYFCQQTWYDPLTFGQGTKLEIK

SEQ ID NO: 2522 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASIPESGVPARFSGSGSGTDFTLTISSLEPEDFAVYFCQQSWYDPLTFGQGTKLEIK

SEQ ID NO: 2523 - protein, 107 aa, Artificial Sequence
  Description of Artificial Sequence: Synthetic polypeptide
AIVLTQSPGTLSLSPGERATLSCRASQSVATHMHWYQQKPGQAPRLLIYGASNLESGVPARFSGSGSGTDFTLTISSLEPEDFAVYYCQQSWYDPLTFGQGTKLEIK

SEQ ID NO: 2524 - protein, 107 aa, Artificial Sequence
  Description of Artificial Sequence: Synthetic polypeptide
EIVLTQSPATLSLSPGERATLSCRASQSVNNHMHWYQQKPGQAPRLLIYGASILESGVPARFSGSGSGTDFTLTISSLEPEDFAVYFCQQSWYDPLTFGQGTKLEIK

SEQ ID NO: 2525 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASKLESGVPARFSGSGSGTDFTLTISSLEPEDFAVYYCQQSWYDPLTFGQGTKLEIK

SEQ ID NO: 2526 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQSWYDPLTFGQGTKLEIK

SEQ ID NO: 2527 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK

SEQ ID NO: 2528 - protein, 107 aa, Artificial Sequence
  Description of Artificial Sequence: Synthetic polypeptide
EIVLTQSPATLSLSPGERATLSCRASQSVATHMHWYQQKPGQAPRLLIYGASNLESGVPARFSGSGSGTDFTLTISSLEPEDFAVYYCQQSWYDPLTFGQGTKLEIK

SEQ ID NO: 2529 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYFCQQTWYDPLTFGQGTKLEIK

SEQ ID NO: 2530 - protein, 107 aa, Artificial Sequence
  Description of Artificial Sequence: Synthetic polypeptide
  MOD_RES (89)..(89): Any amino acid
EIVLTQSPATLSLSPGERATLSCRASQSVSTHMHWYQQKPGQAPRLLIYGASILESGVPARFSGSGSGTDFTLTITSLEPEDFAVYFCXQTWYDPLTFGQGTKLEIK

SEQ ID NO: 2531 - protein, 107 aa, Artificial Sequence
  Description of Artificial Sequence: Synthetic polypeptide
EIVLTQSPATLSLSPGERATLFCRASQSVSNHMHWYQQKPGQAPRLLIYGASILESGVPARFSGSGSGTDFTLTISSLEPEDFAVYYCQQSWYDPITFGQGTKLRSN

SEQ ID NO: 2532 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYYCQQTWYDPLTFGQGTKLEIK

SEQ ID NO: 2533 - protein, 107 aa, Artificial Sequence
  Description of Artificial Sequence: Synthetic polypeptide
EIVLTQSPGTLSLSPGERASLSCRASQSVSTHMHWYQQKPGQAPRLLIYGASNLESGIPARFSGSGSGTDFTLTISSLEPEDFAVYYCQQSFYDPLTFGRGTKLEIK

SEQ ID NO: 2534 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQSWYDPLTFGQGTKLEIN

SEQ ID NO: 2535 - protein, 107 aa, Artificial Sequence
  Description of Artificial Sequence: Synthetic polypeptide
EIVLTQSPATLSLSPGERATLSCRTSESVGKHMHWYQQKPGQAPRLLIYAASNLESGVPARFSGSGSGTDFTLTISSLEPEDFAVYYCQQSWYDPLTFGQGTKLEIK

SEQ ID NO: 2536 - protein, 107 aa, Artificial Sequence
  Description of Artificial Sequence: Synthetic polypeptide
EIVLTQSPATLSLSPGERATLSCRASESVGKHMHWYQQKPGQAPRLLIYAASNLESGVPARFSGSGSGTDFTLTISSLEPEDFAVYYCQQSWYDPLTFGQGTKLEIK

SEQ ID NO: 2537 - protein, 107 aa, Artificial Sequence; identical to SEQ ID NO: 44
  Description of Artificial Sequence: Synthetic polypeptide

SEQ ID NO: 2538 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASILESGVPARFSGSGSGTDFTLTISSLEPEDFAVYFCQQTWYDPLTFGQGTKLEIK

SEQ ID NO: 2539 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSFYDPLTFGQGTKLEIQ

SEQ ID NO: 2540 - protein, 107 aa, Artificial Sequence
  Description of Artificial Sequence: Synthetic polypeptide
EIVLTQSPATLSLSPGERATLSCRASQSVSKHMHWYQQKPGQAPRLLIYGASNLESGIPARFSGSGSGTDFTLTISSLEPEDFAVYFCQQTWYDPITFGQGTKLEIK

SEQ ID NO: 2541 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGVPARFSGSGSGTDFTLTISSLEPEDFAVYYCQQTWYDPLTFGQGTKLEIK

SEQ ID NO: 2542 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSFYDPLTFGQGTKLEIK

SEQ ID NO: 2543 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYFCQQSWYDPLTFGQGTKLEIK

SEQ ID NO: 2544 - protein, 123 aa, Artificial Sequence
  Description of Artificial Sequence: Synthetic polypeptide
  MOD_RES (12)..(12): Lys or Arg
  MOD_RES (23)..(23): Lys, Ser or Asn
  MOD_RES (30)..(30): Thr, Gln, Asp, Glu, Asn, Ala, Gly, His, Lys, Met, Leu, Arg, Ile, Tyr or Val
  MOD_RES (31)..(31): Asn, Ser, Lys, Tyr, Thr, Met, Gly, Ala, Ile, Leu, Glu, Pro, Gln or Phe
  MOD_RES (33)..(33): Gly, Ser, Asp, Lys, Cys, Val, Glu, Leu, Trp, Pro, Tyr, Met, Asn or Thr
  MOD_RES (54)..(54): Glu, Tyr, Leu, Val, Trp, Ala, Gln, His, Gly, Lys, Asn, Met, Thr or Pro
  MOD_RES (57)..(57): Lys, Asn, Asp, Thr, Pro, Trp, Tyr, Val, Ser, Met, Ala, Ile, Gly, Arg or Leu
  MOD_RES (59)..(59): Thr, Ile, Met, Lys, Ala, Asn, Pro, Leu, Val, Trp, Asp, Tyr, Gly or Glu
  MOD_RES (62)..(62): Asp, Tyr or His
  MOD_RES (65)..(65): Lys or Asn
  MOD_RES (79)..(79): Ala or Thr
  MOD_RES (88)..(88): Ala, Asp or Thr
  MOD_RES (99)..(99): Thr, Tyr, Gly, Ile, Ser, Lys, Asn, Pro, Leu, Trp, Met, Phe, Arg or Gln
  MOD_RES (100)..(100): Asn, His, Ile, Thr, Asp, Phe, Leu, Glu, Val, Tyr, Ala, Gly, Trp, Gln or Arg
  MOD_RES (104)..(104): Arg, Ser, Asn, Glu, Met, Leu, Thr, Trp, Gln, Gly, Ile, Ala, Cys or Val
  MOD_RES (105)..(105): Any amino acid
  MOD_RES (107)..(107): Ile, Leu, Asn, Thr, Val, Ala, Arg, Phe, Asp or Ser
  MOD_RES (121)..(121): Val or Ser
  MOD_RES (122)..(122): Ser, Phe or Leu
  MOD_RES (123)..(123): Ser or Gln
EVQLVQSGSELXKPGASVKVSCXASGYTFXXYXMYWVRQAPGQGLEWMGWINTXTGXPXYAXDFXGRFVFSLDTSVSTXYLQISSLKXEDTAVYYCARXXYYYXXYXFYFDYWGQGTMVTXXX

SEQ ID NO: 2545 - protein, 107 aa, Artificial Sequence
  Description of Artificial Sequence: Synthetic polypeptide
  MOD_RES (20)..(20): Thr or Ala
  MOD_RES (30)..(30): Ser, Asn, Asp, Thr, Arg, His, Glu, Ile, Leu, Gln, Cys, Met, Tyr, Lys or Val
  MOD_RES (31)..(31): Thr, Ser, Arg, Ala, Glu, Asp, Met, Pro, Tyr, Ile, Trp or Phe
  MOD_RES (32)..(32): His, Ala, Asp, Cys, Pro, Arg, Tyr, Leu, Gln or Lys
  MOD_RES (34)..(34): His, Ala or Pro
  MOD_RES (50)..(50): Gly, Trp, Val, Ile, Glu, Ser or Asp
  MOD_RES (53)..(53): Asn, His, Tyr, Met, Thr, Phe, Val, Arg, Gln, Ala, Ser, Glu, Gly, Cys, Asp or Pro
  MOD_RES (56)..(56): Ser or Tyr
  MOD_RES (91)..(91): Ser, Cys, Gly, Ile, Trp, Arg, Asn, Ala, Tyr, Lys, Gln or Phe
  MOD_RES (92)..(92): Trp, Cys, Leu, Gly, Glu or Ser
  MOD_RES (93)..(93): Asn, Ile, Thr, Asp, Gly, Met, Ser, His, Ala, Arg, Val, Leu, Phe, Lys or Gln
  MOD_RES (94)..(94): Asp, Asn, Tyr, Ala, Leu, Met, Pro, Gly, His, Phe or Lys
  MOD_RES (96)..(96): Phe, Met, Gly, Tyr, Ala, Trp, Ser, Val, Cys or Pro
  MOD_RES (105)..(105): Glu or Gly
EIVLTQSPATLSLSPGERAXLSCRASESVXXXMXWYQQKPGQAPRLLIYXASXLEXGVPARFSGSGSGTDFTLTISSLEPEDFAVYFCQQXXXXPXTFGQGTKLXIK

SEQ ID NO: 2546 - protein, 123 aa, Artificial Sequence; identical to SEQ ID NO: 2049
  Description of Artificial Sequence: Synthetic polypeptide

SEQ ID NO: 2547 - protein, 10 aa, Artificial Sequence
  Description of Artificial Sequence: Synthetic peptide
GYTFTDYGMY

SEQ ID NO: 2548 - protein, 17 aa, Artificial Sequence
  Description of Artificial Sequence: Synthetic peptide
WIDTETGEPTYADDFKG

SEQ ID NO: 2549 - protein, 14 aa, Artificial Sequence
  Description of Artificial Sequence: Synthetic peptide
TNYYYRSYMFYFDY

SEQ ID NO: 2550 - protein, 107 aa, Artificial Sequence; identical to SEQ ID NO: 2481
  Description of Artificial Sequence: Synthetic polypeptide

SEQ ID NO: 2551 - protein, 11 aa, Artificial Sequence
  Description of Artificial Sequence: Synthetic peptide
RASESVSTHMH

SEQ ID NO: 2552 - protein, 7 aa, Artificial Sequence
  Description of Artificial Sequence: Synthetic peptide
GASNLES

SEQ ID NO: 2553 - protein, 9 aa, Artificial Sequence
  Description of Artificial Sequence: Synthetic peptide
QQSWNDPFT

SEQ ID NO: 2554 - protein, 123 aa, Artificial Sequence; identical to SEQ ID NO: 2049
  Description of Artificial Sequence: Synthetic polypeptide

SEQ ID NO: 2555 - protein, 10 aa, Artificial Sequence
  Description of Artificial Sequence: Synthetic peptide
GYTFTDYGMY

SEQ ID NO: 2556 - protein, 17 aa, Artificial Sequence
  Description of Artificial Sequence: Synthetic peptide
WIDTETGEPTYADDFKG

SEQ ID NO: 2557 - protein, 14 aa, Artificial Sequence
  Description of Artificial Sequence: Synthetic peptide
TNYYYRSYMFYFDY

SEQ ID NO: 2558 - protein, 107 aa, Artificial Sequence; identical to SEQ ID NO: 2473
  Description of Artificial Sequence: Synthetic polypeptide

SEQ ID NO: 2559 - protein, 11 aa, Artificial Sequence
  Description of Artificial Sequence: Synthetic peptide
RASQSVGTHMH

SEQ ID NO: 2560 - protein, 7 aa, Artificial Sequence
  Description of Artificial Sequence: Synthetic peptide
GASHLES

SEQ ID NO: 2561 - protein, 9 aa, Artificial Sequence
  Description of Artificial Sequence: Synthetic peptide
QQTWYDPLT

SEQ ID NO: 2562 - protein, 123 aa, Artificial Sequence; identical to SEQ ID NO: 2047
  Description of Artificial Sequence: Synthetic polypeptide

SEQ ID NO: 2563 - protein, 10 aa, Artificial Sequence
  Description of Artificial Sequence: Synthetic peptide
GYTFTNYGMY

SEQ ID NO: 2564 - protein, 17 aa, Artificial Sequence
  Description of Artificial Sequence: Synthetic peptide
WIDTETGEPTYAQGFTG

SEQ ID NO: 2565 - protein, 14 aa, Artificial Sequence
  Description of Artificial Sequence: Synthetic peptide
TNYYYPSYMFYFDY

SEQ ID NO: 2566 - protein, 107 aa, Artificial Sequence; identical to SEQ ID NO: 2479
  Description of Artificial Sequence: Synthetic polypeptide

SEQ ID NO: 2567 - protein, 11 aa, Artificial Sequence
  Description of Artificial Sequence: Synthetic peptide
RASQSVGTHMH

SEQ ID NO: 2568 - protein, 7 aa, Artificial Sequence
  Description of Artificial Sequence: Synthetic peptide
GASKLES

SEQ ID NO: 2569 - protein, 9 aa, Artificial Sequence
  Description of Artificial Sequence: Synthetic peptide
QQSWYDPLT

SEQ ID NO: 2570 - protein, 123 aa, Artificial Sequence; identical to SEQ ID NO: 2061
  Description of Artificial Sequence: Synthetic polypeptide

SEQ ID NO: 2571 - protein, 10 aa, Artificial Sequence
  Description of Artificial Sequence: Synthetic peptide
GYTFTDYGMY

SEQ ID NO: 2572 - protein, 17 aa, Artificial Sequence
  Description of Artificial Sequence: Synthetic peptide
WIDTETGNPTYADDFKG

SEQ ID NO: 2573 - protein, 14 aa, Artificial Sequence
  Description of Artificial Sequence: Synthetic peptide
TNYYYPSYMFYFDY

SEQ ID NO: 2574 - protein, 107 aa, Artificial Sequence; identical to SEQ ID NO: 2540
  Description of Artificial Sequence: Synthetic polypeptide

SEQ ID NO: 2575 - protein, 11 aa, Artificial Sequence
  Description of Artificial Sequence: Synthetic peptide
RASQSVSKHMH

SEQ ID NO: 2576 - protein, 7 aa, Artificial Sequence
  Description of Artificial Sequence: Synthetic peptide
GASNLES

SEQ ID NO: 2577 - protein, 9 aa, Artificial Sequence
  Description of Artificial Sequence: Synthetic peptide
QQTWYDPIT

SEQ ID NO: 2578 - protein, 123 aa, Artificial Sequence; identical to SEQ ID NO: 2048
  Description of Artificial Sequence: Synthetic polypeptide

SEQ ID NO: 2579 - protein, 10 aa, Artificial Sequence
  Description of Artificial Sequence: Synthetic peptide
GYTFTNYGMY

SEQ ID NO: 2580 - protein, 17 aa, Artificial Sequence
  Description of Artificial Sequence: Synthetic peptide
WIDTETGEPTYADDFKG

SEQ ID NO: 2581 - protein, 14 aa, Artificial Sequence
  Description of Artificial Sequence: Synthetic peptide
TNYYYRSYMFYFDY

SEQ ID NO: 2582 - protein, 107 aa, Artificial Sequence; identical to SEQ ID NO: 2482
  Description of Artificial Sequence: Synthetic polypeptide

SEQ ID NO: 2583 - protein, 11 aa, Artificial Sequence
  Description of Artificial Sequence: Synthetic peptide
RASQSVSTHMH

SEQ ID NO: 2584 - protein, 7 aa, Artificial Sequence
  Description of Artificial Sequence: Synthetic peptide
GASNLES

SEQ ID NO: 2585 - protein, 9 aa, Artificial Sequence
  Description of Artificial Sequence: Synthetic peptide
QQSWYDPLT

SEQ ID NO: 2586 - protein, 123 aa, Artificial Sequence; identical to SEQ ID NO: 2077
  Description of Artificial Sequence: Synthetic polypeptide

SEQ ID NO: 2587 - protein, 10 aa, Artificial Sequence
  Description of Artificial Sequence: Synthetic peptide
GYTFTDYGMY

SEQ ID NO: 2588 - protein, 17 aa, Artificial Sequence
  Description of Artificial Sequence: Synthetic peptide
WIDTETGEPTYADDFKG

SEQ ID NO: 2589 - protein, 14 aa, Artificial Sequence
  Description of Artificial Sequence: Synthetic peptide
TNYYYSSYMFYFDY

SEQ ID NO: 2590 - protein, 107 aa, Artificial Sequence; identical to SEQ ID NO: 2527
  Description of Artificial Sequence: Synthetic polypeptide

SEQ ID NO: 2591 - protein, 11 aa, Artificial Sequence
  Description of Artificial Sequence: Synthetic peptide
RASQSVSTHMH

SEQ ID NO: 2592 - protein, 7 aa, Artificial Sequence
  Description of Artificial Sequence: Synthetic peptide
GASNLES

SEQ ID NO: 2593 - protein, 9 aa, Artificial Sequence
  Description of Artificial Sequence: Synthetic peptide
QQSWYDPLT

SEQ ID NO: 2594 - protein, 123 aa, Artificial Sequence; identical to SEQ ID NO: 2079
  Description of Artificial Sequence: Synthetic polypeptide

SEQ ID NO: 2595 - protein, 10 aa, Artificial Sequence
  Description of Artificial Sequence: Synthetic peptide
GYTFPNYGMY

SEQ ID NO: 2596 - protein, 17 aa, Artificial Sequence
  Description of Artificial Sequence: Synthetic peptide
WIDTETGEPTYADDFKG

SEQ ID NO: 2597 - protein, 14 aa, Artificial Sequence
  Description of Artificial Sequence: Synthetic peptide
TNYYYRSYMFYFDY

SEQ ID NO: 2598 - protein, 107 aa, Artificial Sequence; identical to SEQ ID NO: 2528
  Description of Artificial Sequence: Synthetic polypeptide

SEQ ID NO: 2599 - protein, 11 aa, Artificial Sequence
  Description of Artificial Sequence: Synthetic peptide
RASQSVATHMH

SEQ ID NO: 2600 - protein, 7 aa, Artificial Sequence
  Description of Artificial Sequence: Synthetic peptide
GASNLES

SEQ ID NO: 2601 - protein, 9 aa, Artificial Sequence
  Description of Artificial Sequence: Synthetic peptide
QQSWYDPLT

SEQ ID NO: 2602 - protein, 123 aa, Artificial Sequence; identical to SEQ ID NO: 2059
  Description of Artificial Sequence: Synthetic polypeptide

SEQ ID NO: 2603 - protein, 10 aa, Artificial Sequence
  Description of Artificial Sequence: Synthetic peptide
GYTFSNYGMY

SEQ ID NO: 2604 - protein, 17 aa, Artificial Sequence
  Description of Artificial Sequence: Synthetic peptide
WIDTETGEPTYADDFKG

SEQ ID NO: 2605 - protein, 14 aa, Artificial Sequence
  Description of Artificial Sequence: Synthetic peptide
TNYYYSSYMFYFDY

SEQ ID NO: 2606 - protein, 107 aa, Artificial Sequence; identical to SEQ ID NO: 2543
  Description of Artificial Sequence: Synthetic polypeptide

SEQ ID NO: 2607 - protein, 11 aa, Artificial Sequence
  Description of Artificial Sequence: Synthetic peptide
RASQSVSTHMH

SEQ ID NO: 2608 - protein, 7 aa, Artificial Sequence
  Description of Artificial Sequence: Synthetic peptide
GASNLES

SEQ ID NO: 2609 - protein, 9 aa, Artificial Sequence
  Description of Artificial Sequence: Synthetic peptide
QQSWYDPLT

SEQ ID NO: 2610 - protein, 123 aa, Artificial Sequence; identical to SEQ ID NO: 2051
  Description of Artificial Sequence: Synthetic polypeptide

SEQ ID NO: 2611 - protein, 10 aa, Artificial Sequence
  Description of Artificial Sequence: Synthetic peptide
GYTFSDYGMY

SEQ ID NO: 2612 - protein, 17 aa, Artificial Sequence
  Description of Artificial Sequence: Synthetic peptide
WIDTETGDPTYADDFKG

SEQ ID NO: 2613 - protein, 14 aa, Artificial Sequence
  Description of Artificial Sequence: Synthetic peptide
TNYYYPSYMFYFDY

SEQ ID NO: 2614 - protein, 107 aa, Artificial Sequence; identical to SEQ ID NO: 2538
  Description of Artificial Sequence: Synthetic polypeptide

SEQ ID NO: 2615 - protein, 11 aa, Artificial Sequence
  Description of Artificial Sequence: Synthetic peptide
RASQSVSTHMH

SEQ ID NO: 2616 - protein, 7 aa, Artificial Sequence
  Description of Artificial Sequence: Synthetic peptide
GASILES

SEQ ID NO: 2617 - protein, 9 aa, Artificial Sequence
  Description of Artificial Sequence: Synthetic peptide
QQTWYDPLT

SEQ ID NO: 2618 - protein, 123 aa, Artificial Sequence; identical to SEQ ID NO: 2078
  Description of Artificial Sequence: Synthetic polypeptide

SEQ ID NO: 2619 - protein, 10 aa, Artificial Sequence
  Description of Artificial Sequence: Synthetic peptide
GYTFTDYGMY

SEQ ID NO: 2620 - protein, 17 aa, Artificial Sequence
  Description of Artificial Sequence: Synthetic peptide
WIDTETGEPTYADDFKG

SEQ ID NO: 2621 - protein, 14 aa, Artificial Sequence
  Description of Artificial Sequence: Synthetic peptide
TNYYYRGYMFYFDY

SEQ ID NO: 2622 - protein, 107 aa, Artificial Sequence; identical to SEQ ID NO: 2524
  Description of Artificial Sequence: Synthetic polypeptide

SEQ ID NO: 2623 - protein, 11 aa, Artificial Sequence
  Description of Artificial Sequence: Synthetic peptide
RASQSVNNHMH

SEQ ID NO: 2624 - protein, 7 aa, Artificial Sequence
  Description of Artificial Sequence: Synthetic peptide
GASILES

SEQ ID NO: 2625 - protein, 9 aa, Artificial Sequence
  Description of Artificial Sequence: Synthetic peptide
QQSWYDPLT

SEQ ID NO: 2626 - protein, 123 aa, Artificial Sequence; identical to SEQ ID NO: 2081
  Description of Artificial Sequence: Synthetic polypeptide

SEQ ID NO: 2627 - protein, 10 aa, Artificial Sequence
  Description of Artificial Sequence: Synthetic peptide
GYTFTNYGMY

SEQ ID NO: 2628 - protein, 17 aa, Artificial Sequence
  Description of Artificial Sequence: Synthetic peptide
WIDTETGEPTYADDFKG

SEQ ID NO: 2629 - protein, 14 aa, Artificial Sequence
  Description of Artificial Sequence: Synthetic peptide
TNYYYKSYMFYFDY

SEQ ID NO: 2630 - protein, 107 aa, Artificial Sequence; identical to SEQ ID NO: 2525
  Description of Artificial Sequence: Synthetic polypeptide

SEQ ID NO: 2631 - protein, 11 aa, Artificial Sequence
  Description of Artificial Sequence: Synthetic peptide
RASQSVSTHMH

SEQ ID NO: 2632 - protein, 7 aa, Artificial Sequence
  Description of Artificial Sequence: Synthetic peptide
GASKLES

SEQ ID NO: 2633 - protein, 9 aa, Artificial Sequence
  Description of Artificial Sequence: Synthetic peptide
QQSWYDPLT

SEQ ID NO: 2634 - protein, 123 aa, Artificial Sequence; identical to SEQ ID NO: 2042
  Description of Artificial Sequence: Synthetic polypeptide

SEQ ID NO: 2635 - protein, 10 aa, Artificial Sequence
  Description of Artificial Sequence: Synthetic peptide
GYTFENYGMY

SEQ ID NO: 2636 - protein, 17 aa, Artificial Sequence
  Description of Artificial Sequence: Synthetic peptide
WIDTETGEPTYADDFKG

SEQ ID NO: 2637 - protein, 14 aa, Artificial Sequence
  Description of Artificial Sequence: Synthetic peptide
TNYYYSSYMFYFDY

SEQ ID NO: 2638 - protein, 107 aa, Artificial Sequence; identical to SEQ ID NO: 2479
  Description of Artificial Sequence: Synthetic polypeptide

SEQ ID NO: 2639 - protein, 11 aa, Artificial Sequence
  Description of Artificial Sequence: Synthetic peptide
RASQSVGTHMH

SEQ ID NO: 2640 - protein, 7 aa, Artificial Sequence
  Description of Artificial Sequence: Synthetic peptide
GASKLES

SEQ ID NO: 2641 - protein, 9 aa, Artificial Sequence
  Description of Artificial Sequence: Synthetic peptide
QQSWYDPLT

SEQ ID NO: 2642 - protein, 123 aa, Artificial Sequence; identical to SEQ ID NO: 2045
  Description of Artificial Sequence: Synthetic polypeptide

SEQ ID NO: 2643 - protein, 10 aa, Artificial Sequence
  Description of Artificial Sequence: Synthetic peptide
GYTFSDYGMY

SEQ ID NO: 2644 - protein, 17 aa, Artificial Sequence
  Description of Artificial Sequence: Synthetic peptide
WIDTETGDPTYADDFKG

SEQ ID NO: 2645 - protein, 14 aa, Artificial Sequence
  Description of Artificial Sequence: Synthetic peptide
ANYYYRSYMFYFDY

SEQ ID NO: 2646 - protein, 107 aa, Artificial Sequence; identical to SEQ ID NO: 2474
  Description of Artificial Sequence: Synthetic polypeptide

SEQ ID NO: 2647 - protein, 11 aa, Artificial Sequence
  Description of Artificial Sequence: Synthetic peptide
RASQSVSTHMH

SEQ ID NO: 2648 - protein, 7 aa, Artificial Sequence
  Description of Artificial Sequence: Synthetic peptide
GASNLES

SEQ ID NO: 2649 - protein, 9 aa, Artificial Sequence
  Description of Artificial Sequence: Synthetic peptide
QQSWYDPMT

SEQ ID NO: 2650 - protein, 123 aa, Artificial Sequence; identical to SEQ ID NO: 2067
  Description of Artificial Sequence: Synthetic polypeptide

SEQ ID NO: 2651 - protein, 10 aa, Artificial Sequence
  Description of Artificial Sequence: Synthetic peptide
GYTFTDYGMY

SEQ ID NO: 2652 - protein, 17 aa, Artificial Sequence
  Description of Artificial Sequence: Synthetic peptide
WIDTETGEPTYADDFKG

SEQ ID NO: 2653 - protein, 14 aa, Artificial Sequence
  Description of Artificial Sequence: Synthetic peptide
TNYYYPSYMFYFDY

SEQ ID NO: 2654 - protein, 107 aa, Artificial Sequence; identical to SEQ ID NO: 2529
  Description of Artificial Sequence: Synthetic polypeptide

SEQ ID NO: 2655 - protein, 11 aa, Artificial Sequence
  Description of Artificial Sequence: Synthetic peptide
RASQSVSTHMH

SEQ ID NO: 2656 - protein, 7 aa, Artificial Sequence
  Description of Artificial Sequence: Synthetic peptide
GASNLES

SEQ ID NO: 2657 - protein, 9 aa, Artificial Sequence
  Description of Artificial Sequence: Synthetic peptide
QQTWYDPLT

SEQ ID NO: 2658 - protein, 123 aa, Artificial Sequence; identical to SEQ ID NO: 2062
  Description of Artificial Sequence: Synthetic polypeptide

SEQ ID NO: 2659 - protein, 10 aa, Artificial Sequence
  Description of Artificial Sequence: Synthetic peptide
GYTFTDYGMY

SEQ ID NO: 2660 - protein, 17 aa, Artificial Sequence
  Description of Artificial Sequence: Synthetic peptide
WIDTETGQPTYADDFKG

SEQ ID NO: 2661 - protein, 14 aa, Artificial Sequence
  Description of Artificial Sequence: Synthetic peptide
TNYYYRSYMFYFDY

SEQ ID NO: 2662 - protein, 107 aa, Artificial Sequence; identical to SEQ ID NO: 2536
  Description of Artificial Sequence: Synthetic polypeptide

SEQ ID NO: 2663 - protein, 11 aa, Artificial Sequence
  Description of Artificial Sequence: Synthetic peptide
RASESVGKHMH

SEQ ID NO: 2664 - protein, 7 aa, Artificial Sequence
  Description of Artificial Sequence: Synthetic peptide
AASNLES

SEQ ID NO: 2665 - protein, 9 aa, Artificial Sequence
  Description of Artificial Sequence: Synthetic peptide
QQSWYDPLT

SEQ ID NO: 2666 - protein, 123 aa, Artificial Sequence; identical to SEQ ID NO: 43
  Description of Artificial Sequence: Synthetic polypeptide

SEQ ID NO: 2667 - protein, 10 aa, Artificial Sequence
  Description of Artificial Sequence: Synthetic peptide
GYTFTDYGMY

SEQ ID NO: 2668 - protein, 17 aa, Artificial Sequence
  Description of Artificial Sequence: Synthetic peptide
WIDTETGDPTYADDFKG

SEQ ID NO: 2669 - protein, 14 aa, Artificial Sequence
  Description of Artificial Sequence: Synthetic peptide
TNYYYRNYMFYFDY

SEQ ID NO: 2670 - protein, 107 aa, Artificial Sequence; identical to SEQ ID NO: 44
  Description of Artificial Sequence: Synthetic polypeptide

SEQ ID NO: 2671 - protein, 11 aa, Artificial Sequence
  Description of Artificial Sequence: Synthetic peptide
RASQSVSNHMH

SEQ ID NO: 2672 - protein, 7 aa, Artificial Sequence
  Description of Artificial Sequence: Synthetic peptide
GASILES

SEQ ID NO: 2673 - protein, 9 aa, Artificial Sequence
  Description of Artificial Sequence: Synthetic peptide
QQSWYDPIT

SEQ ID NO: 2674 - protein, 123 aa, Artificial Sequence; identical to SEQ ID NO: 2046
  Description of Artificial Sequence: Synthetic polypeptide

SEQ ID NO: 2675 - protein, 10 aa, Artificial Sequence
  Description of Artificial Sequence: Synthetic peptide
GYTFDDYGMY

SEQ ID NO: 2676 - protein, 17 aa, Artificial Sequence
  Description of Artificial Sequence: Synthetic peptide
WIDTETGTPTYADDFKG

SEQ ID NO: 2677 - protein, 14 aa, Artificial Sequence
  Description of Artificial Sequence: Synthetic peptide
TNYYYSSYMFYFDY

SEQ ID NO: 2678 - protein, 107 aa, Artificial Sequence; identical to SEQ ID NO: 2527
  Description of Artificial Sequence: Synthetic polypeptide

SEQ ID NO: 2679 - protein, 11 aa, Artificial Sequence
  Description of Artificial Sequence: Synthetic peptide
RASQSVSTHMH

SEQ ID NO: 2680 - protein, 7 aa, Artificial Sequence
  Description of Artificial Sequence: Synthetic peptide
GASNLES

SEQ ID NO: 2681 - protein, 9 aa, Artificial Sequence
  Description of Artificial Sequence: Synthetic peptide
QQSWYDPLT

SEQ ID NO: 2682 - protein, 123 aa, Artificial Sequence; identical to SEQ ID NO: 2054
  Description of Artificial Sequence: Synthetic polypeptide

SEQ ID NO: 2683 - protein, 10 aa, Artificial Sequence
  Description of Artificial Sequence: Synthetic peptide
GYTFTDYGMY

SEQ ID NO: 2684 - protein, 17 aa, Artificial Sequence
  Description of Artificial Sequence: Synthetic peptide
WIDTETGEPTYAQGFTG

SEQ ID NO: 2685 - protein, 14 aa, Artificial Sequence
  Description of Artificial Sequence: Synthetic peptide
TNYYYRSYMFYFDY

SEQ ID NO: 2686 - protein, 107 aa, Artificial Sequence; identical to SEQ ID NO: 2541
  Description of Artificial Sequence: Synthetic polypeptide

SEQ ID NO: 2687 - protein, 11 aa, Artificial Sequence
  Description of Artificial Sequence: Synthetic peptide
RASQSVSTHMH

SEQ ID NO: 2688 - protein, 7 aa, Artificial Sequence
  Description of Artificial Sequence: Synthetic peptide
GASNLES

SEQ ID NO: 2689 - protein, 9 aa, Artificial Sequence
  Description of Artificial Sequence: Synthetic peptide
QQTWYDPLT

SEQ ID NO: 2690 - protein, 123 aa, Artificial Sequence; identical to SEQ ID NO: 2060
  Description of Artificial Sequence: Synthetic polypeptide

SEQ ID NO: 2691 - protein, 10 aa, Artificial Sequence
  Description of Artificial Sequence: Synthetic peptide
GYTFTHYGMY

SEQ ID NO: 2692 - protein, 17 aa, Artificial Sequence
  Description of Artificial Sequence: Synthetic peptide
WIDTETGEPTYADDFKG

SEQ ID NO: 2693 - protein, 14 aa, Artificial Sequence
  Description of Artificial Sequence: Synthetic peptide
TNYYYRSYMFYFDY

SEQ ID NO: 2694 - protein, 107 aa, Artificial Sequence; identical to SEQ ID NO: 2542
  Description of Artificial Sequence: Synthetic polypeptide

SEQ ID NO: 2695 - protein, 11 aa, Artificial Sequence
  Description of Artificial Sequence: Synthetic peptide
RASQSVSTHMH

SEQ ID NO: 2696 - protein, 7 aa, Artificial Sequence
  Description of Artificial Sequence: Synthetic peptide
GASNLES

SEQ ID NO: 2697 - protein, 9 aa, Artificial Sequence
  Description of Artificial Sequence: Synthetic peptide
QQSFYDPLT

SEQ ID NO: 2698 - protein, 123 aa, Artificial Sequence; identical to SEQ ID NO: 2084
  Description of Artificial Sequence: Synthetic polypeptide

SEQ ID NO: 2699 - protein, 10 aa, Artificial Sequence
  Description of Artificial Sequence: Synthetic peptide
GYTFSDYGMY

SEQ ID NO: 2700 - protein, 17 aa, Artificial Sequence
  Description of Artificial Sequence: Synthetic peptide
WIDTETGEPTYADDFKG

SEQ ID NO: 2701 - protein, 14 aa, Artificial Sequence
  Description of Artificial Sequence: Synthetic peptide
TNYYYRSYMFYFDY

SEQ ID NO: 2702 - protein, 107 aa, Artificial Sequence; identical to SEQ ID NO: 2526
  Description of Artificial Sequence: Synthetic polypeptide

SEQ ID NO: 2703 - protein, 11 aa, Artificial Sequence
  Description of Artificial Sequence: Synthetic peptide
RASQSVSTHMH

SEQ ID NO: 2704 - protein, 7 aa, Artificial Sequence
  Description of Artificial Sequence: Synthetic peptide
GASNLES

SEQ ID NO: 2705 - protein, 9 aa, Artificial Sequence
  Description of Artificial Sequence: Synthetic peptide
QQSWYDPLT

SEQ ID NO: 2706 - protein, 122 aa, Artificial Sequence
  Description of Artificial Sequence: Synthetic polypeptide
EVTLRESGPALVKPTQTLTLTCTFSGFSLSTYGVGVGWIRQPPGKALEWLANIWWVDEIFYSTSLKTRLTISKDTSKNQVVLTMTNMDPVDTATYYCARIESIGTTYSFDYWGQGTMVTVSS

SEQ ID NO: 2707 - protein, 122 aa, Artificial Sequence
  Description of Artificial Sequence: Synthetic polypeptide
EVTLRESGPALVKPTQTLTLTCTFSGFSLWTSGMGVVWIRQPPGKALEWLALIDWADVKSYNPSLKNRLTISEDTSKNQVVLTMTNMDPVDTATYYCARIESIGTTYSFDYWGQGTMVTVSS

SEQ ID NO: 2708 - protein, 122 aa, Artificial Sequence
  Description of Artificial Sequence: Synthetic polypeptide
EVTLRESGPALVKPTQTLTLTCTFSGFSLSTYGVSVGWIRQPPGKALEWLALIDWYDDMYYSTSLKTRLTISKDTSKNQVVLTMTNMDPVDTATYYCARIESIGTTYSFDYWGQGTMVTVSS

SEQ ID NO: 2709 - protein, 122 aa, Artificial Sequence
  Description of Artificial Sequence: Synthetic polypeptide
EVTLRESGPALVKPTQTLTLTCTFSGFSLSTSGVRVVWIRQPPGKALEWLANIWWDDYLDYSTSLKTRLTISKDTSKNQVVLTMTNMDPVDTATYYCARIESIGTTYSFDYWGQGTMVTVSS

SEQ ID NO: 2710 - protein, 122 aa, Artificial Sequence
  Description of Artificial Sequence: Synthetic polypeptide
EVTLRESGPALVKPTQTLTLTCTFSGFSLSTYGMSVGWIRQPPGKALEWLALIDWADDTYYNPSLNNRLTISKDTSKNQVVLTMTNMDPVDTATYYCARIESIGTTYSFDYWGQGTMVTVSS

SEQ ID NO: 2711 - protein, 122 aa, Artificial Sequence
  Description of Artificial Sequence: Synthetic polypeptide
EVTLRESGPALVKPTQTLTLTCTFSGFSLATYGMSVAWIRQPPGKALEWLALIDWYDDEYYSTSLKTRLTISKDTSKNQVVLTMTNMDPVDTATYYCARIESIGTTYSFDYWGQGTMVTVSS

SEQ ID NO: 2712 - protein, 122 aa, Artificial Sequence
  Description of Artificial Sequence: Synthetic polypeptide
  MOD_RES (30)..(30): Any amino acid
EVTLRESGPALVKPTQTLTLTCTFSGFSLXTYGVGVGWIRQPPGKALEWLANIWWVDDKYYSTSLKTRLTISKDTSKNQVVLTMTNMDPVDTATYYCARIESIGTTYSFDYWGQGTMVTVSS

SEQ ID NO: 2713 - protein, 122 aa, Artificial Sequence
  Description of Artificial Sequence: Synthetic polypeptide
EVTLRESGPALVKPTQTLTLTCTFSGFSLSTSGVGVGWIRQPPGKALEWLALIDWADDKYYNPSLKTRLTISKDTSKNQVVLTMTNMDPVDTATYYCARIESIGTTYSFDYWGQGTMVTVSS

SEQ ID NO: 2714 - protein, 122 aa, Artificial Sequence
  Description of Artificial Sequence: Synthetic polypeptide
EVTLRESGPALVKPTQTLTLTCTFSGFSLCTSGVRVRWIRQPPGKALEWLALIDWDDDKYYNPSLKNRLTISKDTSKNQVVLTMTNMDPVDTATYYCARIESIGTTYSFDYWGQGTMVTVSS

SEQ ID NO: 2715 - protein, 122 aa, Artificial Sequence
  Description of Artificial Sequence: Synthetic polypeptide
  MOD_RES (59)..(59): Any amino acid
EVTLRESGPALVKPTQTLTLTCTFSGFSLSTSGVGVGWIRQPPGKALEWLANIWWDDNXYYSTSLKTRLTISKDTSKNQVVLTMTNMDPVDTATYYCARIESIGTTYSFDYWGQGTMVTVSS

SEQ ID NO: 2716 - protein, 122 aa, Artificial Sequence
  Description of Artificial Sequence: Synthetic polypeptide
EVTLRESGPALVKPTQTLTLTCTFSGFSLATSGVSVGWIRQPPGKALEWLALIDWEDDKGYNPSLKNRLTISKDTSKNQVVLTMTNMDPVDTATYYCARIESIGTTYSFDYWGQGTMVTVSS

SEQ ID NO: 2717 - protein, 122 aa, Artificial Sequence
  Description of Artificial Sequence: Synthetic polypeptide
EVTLRESGPALVKPTQTLTLTCTFSGFSLSTYGMRVGWIRQPPGKALEWLALIDWDDHKYYSTSLKTRLTISKDTSKNQVVLTMTNMDPVDTATYYCARIESIGTTYSFDYWGQGTMVTVSS

SEQ ID NO: 2718 - protein, 122 aa, Artificial Sequence
  Description of Artificial Sequence: Synthetic polypeptide
EVTLRESGPALVKPTQTLTLTCTFSGFSLCTSGVGVGWIRQPPGKALEWLALIDWDDDNYYNPSLKNRLTISKDTSKNQVVLTMTNMDPVDTATYYCARIESIGTTYSFDYWGQGTMVTVSS

SEQ ID NO: 2719 - protein, 122 aa, Artificial Sequence
  Description of Artificial Sequence: Synthetic polypeptide
EVTLRESGPALVKPTQTLTLTCTFSGFSLFTYGMGVGWIRQPPGKALEWLALIDWVDDKFYSTSLKTRLTISKDTSKNQVVLTMTNMDPVDTATYYCARIESIGTTYSFDYWGQGTMVTVSS

SEQ ID NO: 2720 - protein, 122 aa, Artificial Sequence
  Description of Artificial Sequence: Synthetic polypeptide
EVTLRESGPALVKPTQTLTLTCTFSGFSLCTSGVGVGWIRQPPGKALEWLANIWWDDDRYYSTSLKTRLTISKDTSKNQVVLTMTNMDPVDTATYYCARIESIGTTYSFDYWGQGTMVTVSS

SEQ ID NO: 2721 - protein, 122 aa, Artificial Sequence
  Description of Artificial Sequence: Synthetic polypeptide
EVTLRESGPALVKPTQTLTLTCTFSGFSLCTSGMSVGWIRQPPGKALEWLALICWDDDRYYSTSLKTRLTISKDTSKNQVVLTMTNMDPVDTATYYCARIESIGTTYSFDYWGQGTMVTVSS

SEQ ID NO: 2722 - protein, 122 aa, Artificial Sequence
  Description of Artificial Sequence: Synthetic polypeptide
EVTLRESGPALVKPTQTLTLTCTFSGFSLSTSGMRVGWIRQPPGKALEWLALIDWGDDMSYSTSLKTRLTISKDTSKNQVVLTMTNMDPVDTATYYCARIESIGTTYSFDYWGQGTMVTVSS

SEQ ID NO: 2723 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLALIDWEDDKYYSTSLKTRLTISKDTSKNQVVLTMTNMDPVDTATYYCARIESIGTTYSFDYWGQGTMVTVSS

SEQ ID NO: 2724 - protein, 122 aa, Artificial Sequence
  Description of Artificial Sequence: Synthetic polypeptide
EVTLRESGPALVKPTQTLTLTCTFSGFSLLTYGVGVCWIRQPPGKALEGWLNIWWADGKCYSTSLKTRLTISKDTSKNQVVLTMTNMDPVDTATYYCARIESIGTTYSFDYWGQGTMVTVSS

SEQ ID NO: 2725 - protein, 122 aa, Artificial Sequence
  Description of Artificial Sequence: Synthetic polypeptide
EVTLRESGPALVKPTQTLTLTCTFSGFSLSTSGVRVSWIRQPPGKALEWLALIDWDDEECYSTSLKTRLTISKDTSKNQVVLTMTNMDPVDTATYYCARIESIGTTYSFDYWGQGTMVTVSS

SEQ ID NO: 2726 - protein, 122 aa, Artificial Sequence
  Description of Artificial Sequence: Synthetic polypeptide
EVTLRESGPALVKPTQTLTLTCTFSGFSLSTSGMSVSWIRQPPGKALEWLALIDWVDDMGYSTSLKTRLTISKDTSKNQVVLTMTNMDPVDTATYYCARIESIGTTYSFDYWGQGTMVTVSS

SEQ ID NO: 2727 - protein, 122 aa, Artificial Sequence
  Description of Artificial Sequence: Synthetic polypeptide
  MOD_RES (30)..(30): Any amino acid
EVTLRESGPALVKPTQTLTLTCTFSGFSLXTYGMGVGWIRQPPGKALEWLALIDWADYRSYNPSLKNRLTISKDTSKNQVVLTMTNMDPVDTATYYCARIESIGTTYSFDYWGQGTMVTVSS

SEQ ID NO: 2728 - protein, 122 aa, Artificial Sequence
  Description of Artificial Sequence: Synthetic polypeptide
EVTLRESGPALVKPTQTLTLTCTFSGFSLATYGVGVGWIRQPPGKALEWLALIDWEDAVNYSTSLKTRLTISKDTSKNQVVLTMTNMDPVDTATYYCARIESIGTTYSFDYWGQGTMVTVSS

SEQ ID NO: 2729 - protein, 122 aa, Artificial Sequence
  Description of Artificial Sequence: Synthetic polypeptide
EVTLRESGPALVKPTQTLTLTCTFSGFSLCTYGMGVCWIRQPPGKALEWLALIGWDDENYYNPSLKNRLTISKDTSKNQVVLTMTNMDPVDTATYYCARIESIGTTYSFDYWGQGTMVTVSS

SEQ ID NO: 2730 - protein, 122 aa, Artificial Sequence
  Description of Artificial Sequence: Synthetic polypeptide
EVTLRESGPALVKPTQTLTLTCTFSGFSLTTYGVRVGWIRQPPGKALEWLALIDWDDDKYYSTSLKTRLTISKDTSKNQVVLTMTNMDPVDTATYYCARIESIGTTYSFDYWGQGTMVTVSS

SEQ ID NO: 2731 - protein, 122 aa, Artificial Sequence
  Description of Artificial Sequence: Synthetic polypeptide
EVTLRESGPALVKPTQTLTLTCTFSGFSLSTYGMSVCWIRQPPGKALEWLANIWWDDGCCYSTSLKTRLTISKDTSKNQVVLTMTNMDPVDTATYYCARIESIGTTYSFDYWGQGTMVTVSS

SEQ ID NO: 2732 - protein, 122 aa, Artificial Sequence
  Description of Artificial Sequence: Synthetic polypeptide
EVTLRESGPALVKPTQTLTLTCTFSGFSLSTSGMRVGWIRQPPGKALEWLALIDWCDDKYYSTSLKTRLTISKDTSKNQVVLTMTNMDPVDTATYYCARIESIGTTYSFDYWGQGTMVTVSS

SEQ ID NO: 2733 - protein, 122 aa, Artificial Sequence
  Description of Artificial Sequence: Synthetic polypeptide
  MOD_RES (59)..(59): Any amino acid
EVTLRESGPALVKPTQTLTLTCTFSGFSLSTSGMGVSWIRQPPGKALEWLALIDWDDHXHYSTSLKTRLTISKDTSKNQVVLTMTNMDPVDTATYYCARIESIGTTYSFDYWGQGTMVTVSS

SEQ ID NO: 2734 - protein, 122 aa, Artificial Sequence
  Description of Artificial Sequence: Synthetic polypeptide
EVTLRESGPALVKPTQTLTLTCTFSGFSLWTSGVGVGWIRQPPGKALEWLALIDWEDNKDYSTSLKTRLTISKDTSKNQVVLTMTNMDPVDTATYYCARIESIGTTYSFDYWGQGTMVTVSS

SEQ ID NO: 2735 - protein, 122 aa, Artificial Sequence
  Description of Artificial Sequence: Synthetic polypeptide
EVTLRESGPALVKPTQTLTLTCTFSGFSLSTSGVRVGWIRQPPGKALEWLALIDWVDDMYYSTSLKTRLTISKDTSKNQVVLTMTNMDPVDTATYYCARIESIGTTYSFDYWGQGTMVTVSS

SEQ ID NO: 2736 - protein, 122 aa, Artificial Sequence
  Description of Artificial Sequence: Synthetic polypeptide
EVTLRESGPALVKPTQTLTLTCTFSGFSLSTYGMGVEWIRQPPGKALEWLALIDWDDDKDYNPSLKNRLTISKDTSKNQVVLTMTNMDPVDTATYYCARIESIGTTYSFDYWGQGTMVTVSS

SEQ ID NO: 2737 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLALIDWCDNRYYSTSLKTRLTISKDTSKNQVVLTMTNMDPVDTATYYCARIESIGTTYSFDYWGQGTMVTVSS

SEQ ID NO: 2738 - protein, 122 aa, Artificial Sequence
  Description of Artificial Sequence: Synthetic polypeptide
EVTLRESGPALVKPTQTLTLTCTFSGFSLSTSGMRVGWIRQPPGKALEWLALIDWDDDKYYNPSLKNRLTISKDTSKNQVVLTMTNMDPVDTATYYCARIESIGTTYSFDYWGQGTMVTVSS

SEQ ID NO: 2739 - protein, 122 aa, Artificial Sequence
  Description of Artificial Sequence: Synthetic polypeptide
EVTLRESGPALVKPTQTLTLTCTFSGFSLRTYGVSVGWIRQPPGKALEWLALIDWYDGKYYNPSLKNRLTISKDTSKNQVVLTMTNMDPVDTATYYCARIESIGTTYSFDYWGQGTMVTVSS

SEQ ID NO: 2740 - protein, 122 aa, Artificial Sequence
  Description of Artificial Sequence: Synthetic polypeptide
EVTLRESGPALVKPTQTLTLTCTFSGFSLSTYGMGVDWIRQPPGKALEWLALIDWEDDKSYSTSLKTRLTISKDTSKNQVVLTMTNMDPVDTATYYCARIESIGTTYSFDYWGQGTMVTVSS

SEQ ID NO: 2741 - protein, 122 aa, Artificial Sequence
  Description of Artificial Sequence: Synthetic polypeptide
EVTLRESGPALVKPTQTLTLTCTFSGFSLWTYGVSVRWIRQPPGKALEWLALIDWDDVKYYSTSLKTRLTISKDTSKNQVVLTMTNMDPVDTATYYCARIESIGTTYSFDYWGQGTMVTVSS

SEQ ID NO: 2742 - protein, 122 aa, Artificial Sequence
  Description of Artificial Sequence: Synthetic polypeptide
EVTLRESGPALVKPTQTLTLTCTFSGFSLSTSGVGVGWIRQPPGKALEWLALIDWDDDKFYSTSLKTRLTISKDTSKNQVVLTMTNMDPVDTATYYCARIESIGTTYSFDYWGQGTMVTVSS

SEQ ID NO: 2743 - protein, 122 aa, Artificial Sequence
  Description of Artificial Sequence: Synthetic polypeptide
EVTLRESGPALVKPTQTLTLTCTFSGFSLPTYGVRVGWIRQPPGKALEWLANIWWVDNKYYSTSLKTRLTISKDTSKNQVVLTMTNMDPVDTATYYCARIESIGTTYSFDYWGQGTMVTVSS

SEQ ID NO: 2744 - protein, 122 aa, Artificial Sequence
  Description of Artificial Sequence: Synthetic polypeptide
  MOD_RES (30)..(30): Any amino acid
EVTLRESGPALVKPTQTLTLTCTFSGFSLXTSGVRVGWIRQPPGKALEWLALIDWDDYQYYNPSLKNRLTISKDTSKNQVVLTMTNMDPVDTATYYCARIESIGTTYSFDYWGQGTMVTVSS

SEQ ID NO: 2745 - protein, 122 aa, Artificial Sequence
  Description of Artificial Sequence: Synthetic polypeptide
EVTLRESGPALVKPTQTLTLTCTFSGFSLSTYGVSVGWIRQPPGKALEWLANIWWYDLKYYSTSLKTRLTISKDTSKNQVVLTMTNMDPVDTATYYCARIESIGTTYSFDYWGQGTMVTVSS

SEQ ID NO: 2746 - protein, 122 aa, Artificial Sequence
  Description of Artificial Sequence: Synthetic polypeptide
EVTLRESGPALVKPTQTLTLTCTFSGFSLSTYGVGVGWIRQPPGKALEWLALIDWDDDKCYNPSLKNRLTISKDTSKNQVVLTMTNMDPVDTATYYCARIESIGTTYSFDYWGQGTMVTVSS

SEQ ID NO: 2747 - protein, 122 aa, Artificial Sequence
  Description of Artificial Sequence: Synthetic polypeptide
EVTLRESGPALVKPTQTLTLTCTFSGFSLSTSGVSVGWIRQPPGKALEWLANIWWDDEKAYSTSLKTRLTISKDTSKNQVVLTMTNMDPVDTATYYCARIESIGTTYSFDYWGQGTMVTVSS

SEQ ID NO: 2748 - protein, 122 aa, Artificial Sequence
  Description of Artificial Sequence: Synthetic polypeptide
EVTLRESGPALVKPTQTLTLTCTFSGFSLSTSGVGVSWIRQPPGKALEWLALIDWDDDKYYNPSLKNRLTISKDTSKNQVVLTMTNMDPVDTATYYCARIESIGTTYSFDYWGQGTMVTVSS

SEQ ID NO: 2749 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLALIDWDDDKYYSTSLKTRLTISKDTSKNQVVLTMTNMDPVDTATYYCARIESIGTTYSFDYWGQGTMVTVSS

SEQ ID NO: 2750 - protein, 122 aa, Artificial Sequence
  Description of Artificial Sequence: Synthetic polypeptide
EVTLRESGPALVKPTQTLTLTCTFSGFSLPTSGVSVGWIRQPPGKALEWLANIWWADSKFYSTSLKNRLTISKDTSKNQVVLTMTNMDPVDTATYYCARIESIGTTYSFDYWGQGTMVTVSS

SEQ ID NO: 2751 - protein, 122 aa, Artificial Sequence
  Description of Artificial Sequence: Synthetic polypeptide
  MOD_RES (82)..(82): Any amino acid
EVTLRESGPALVKPTQTLTLTCTFSGFSLSTYGVSVDWIRQPPGKALEWLALIDWGDQTNYNPSLKNRLTISKDTSKNQVVXTMTNMDPVDTATYYCARIESIGTTYSFDYWGQGTMVTVSS

SEQ ID NO: 2752 - protein, 122 aa, Artificial Sequence
  Description of Artificial Sequence: Synthetic polypeptide
EVTLRESGPALVKPTQTLTLTCTFSGFSLSTYGVGVEWIRQPPGKALEWLALIDWYDDKYYSTSLKTRLTISKDTSKNQVVLTMTNMDPVDTATYYCARIESIGTTYSFDYWGQGTMVTVSS

SEQ ID NO: 2753 - protein, 122 aa, Artificial Sequence
  Description of Artificial Sequence: Synthetic polypeptide
EVTLRESGPALVKPTQTLTLTCTFSGFSLPTSGVGVGWIRQPPGKALEWLALIDWEDHMDYSTSLKTRLTISKDTSKNQVVLTMTNMDPVDTATYYCARIESIGTTYSFDYWGQGTMVTVSS

SEQ ID NO: 2754 - protein, 122 aa, Artificial Sequence
  Description of Artificial Sequence: Synthetic polypeptide
  MOD_RES (56)..(56): Any amino acid
EVTLRESGPALVKPTQTLTLTCTFSGFSLSTYGMRVGWIRQPPGKALEWLALIDWXDDKYYNPSLKNRLTISKDTSKNQVVLTMTNMDPVDTATYYCARIESIGTTYSFDYWGQGTMVTVSS

SEQ ID NO: 2755 - protein, 122 aa, Artificial Sequence
  Description of Artificial Sequence: Synthetic polypeptide
EVTLRESGPALVKPTQTLTLTCTFSGFSLTTSGVGVGWIRQPPGKALEWLALIDWYDERFYSTSLKTRLTISKDTSKNQVVLTMTNMDPVDTATYYCARIESIGTTYSFDYWGQGTMVTVSS

SEQ ID NO: 2756 - protein, 122 aa, Artificial Sequence
  Description of Artificial Sequence: Synthetic polypeptide
  MOD_RES (22)..(22): Any amino acid
  MOD_RES (59)..(59): Any amino acid
EVTLRESGPALVKPTQTLTLTXTFSGFSLSTYGMRVGWIRQPPGKALEWLANIWWADNXSYSTSLKTRLTISKDTSKNQVVLTMTNMDPVDTATYYCARIESIGTTYSFDYWGQGTMVTVSS

SEQ ID NO: 2757 - protein, 122 aa, Artificial Sequence
  Description of Artificial Sequence: Synthetic polypeptide
EVTLRESGPALVKPTQTLTLTCTFSGFSLSTYGMSVGWIRQPPGKALEWLALIDWADDNYYSTSLKTRLTISKDTSKNQVVLTMTNMDPVDTATYYCARIESIGTTYSFDYWGQGTMVTVSS

SEQ ID NO: 2758 - protein, 122 aa, Artificial Sequence
  Description of Artificial Sequence: Synthetic polypeptide
EVTLRESGPALVKPTQTLTLTCTFSGFSLSTSGVSVGWIRQPPGKALEWLALIDWEDDKYYNPSLKNRLTISKDTSKNQVVLTMTNMDPVDTATYYCARIESIGTTYSFDYWGQGTMVTVSS

SEQ ID NO: 2759 - protein, 122 aa, Artificial Sequence
  Description of Artificial Sequence: Synthetic polypeptide
EVTLRESGPALVKPTQTLTLTCTFSGFSLWTSGMGVGWIRQPPGKALEWLALIDWDDEKAYNPSLKNRLTISKDTSKNQVVLTMTNMDPVDTATYYCARIESIGTTYSFDYWGQGTMVTVSS

SEQ ID NO: 2760 - protein, 122 aa, Artificial Sequence
  Description of Artificial Sequence: Synthetic polypeptide
EVTLRESGPALVKPTQTLTLTCTFSGFSLWTSGMRVGWIRQPPGKALEWLANIWWDDDKYYSTSLKTRLTISKDTSKNQVVLTMTNMDPVDTATYYCARIESIGTTYSFDYWGQGTMVTVSS

SEQ ID NO: 2761 - protein, 122 aa, Artificial Sequence
  Description of Artificial Sequence: Synthetic polypeptide
EVTLRESGPALVKPTQTLTLTCTFSGFSLSTYGVSVGWIRQPPGKALEWLALIDWHDDKYYNPSLKNRLTISKDTSKNQVVLTMTNMDPVDTATYYCARIESIGTTYSFDYWGQGTMVTVSS

SEQ ID NO: 2762 - protein, 122 aa, Artificial Sequence
  Description of Artificial Sequence: Synthetic polypeptide
EVTLRESGPALVKPTQTLTLTCTFSGFSLSTYGMSVGWIRQPPGKALEWLALIDWNDNKYYNPSLKNRLTISKDTSKNQVVLTMTNMDPVDTATYYCARIESIGTTYSFDYWGQGTMVTVSS

SEQ ID NO: 2763 - protein, 122 aa, Artificial Sequence
  Description of Artificial Sequence: Synthetic polypeptide
EVTLRESGPALVKPTQTLTLTCTFSGFSLSTSGVGVGWIRQPPGKALEWLALIDWDDDKYYSTSLKTRLTISKDTSKNQVVLTMTNMDPVDTATYYCARIESIGTTYSFDYWGQGTMVTVSS

SEQ ID NO: 2764 - protein, 122 aa, Artificial Sequence
  Description of Artificial Sequence: Synthetic polypeptide
EVTLRESGPALVKPTQTLTLTCTFSGFSLSTSGVRVCWIRQPPGKALEWLALIDWDDDKSYNPSLKNRLTISKDTSKNQVVLTMTNMDPVDTATYYCARIESIGTTYSFDYWGQGTMVTVSS

SEQ ID NO: 2765 - protein, 122 aa, Artificial Sequence
  Description of Artificial Sequence: Synthetic polypeptide
EVTLRESGPALVKPTQTLTLTCTFSGFSLSTYGVSVTWIRQPPGKALEWLALIDWNDDNHYSTSLKTRLTISKDTSKNQVVLTMTNMDPVDTATYYCARIESIGTTYSFDYWGQGTMVTVSS

SEQ ID NO: 2766 - protein, 122 aa, Artificial Sequence
  Description of Artificial Sequence: Synthetic polypeptide
EVTLRESGPALVKPTQTLTLTCTFSGFSLSTSGVSVVWIRQPPGKALEWLANIWWDDEKCYSTSLKTRLTISKDTSKNQVVLTMTNMDPVDTATYYCARIESIGTTYSFDYWGQGTMVTVSS

SEQ ID NO: 2767 - protein, 122 aa, Artificial Sequence
  Description of Artificial Sequence: Synthetic polypeptide
EVTLRESGPALVKPTQTLTLTCTFTGFSLYTSGMGVGWIRQPPGKALEWLALIDWDDDKNYSTSLKTRLTISKDTSKNQVVLTMTNMDPVDTATYYCARIESIGTTYSFDYWGQGTMVTVSS

SEQ ID NO: 2768 - protein, 122 aa, Artificial Sequence
  Description of Artificial Sequence: Synthetic polypeptide
EVTLRESGPALVKPTQTLTLTCTFSGFSLFTYGVGVDWIRQPPGKALEWLANIWWPDDNYYSTSLKTRLTISKDTSKNQVVLTMTNMDPVDTATYYCARIESIGTTYSFDYWGQGTMVTVSS

SEQ ID NO: 2769 - protein, 122 aa, Artificial Sequence
  Description of Artificial Sequence: Synthetic polypeptide
  MOD_RES (59)..(59): Any amino acid
EVTLRESGPALVKPTQTLTLTCTFSGFSLSTSGVGVGWIRQPPGKALEWLALIDWDDDXCYNPSLKNRLTISKDTSKNQVVLTMTNMDPVDTATYYCARIESIGTTYSFDYWGQGTMVTVSS

SEQ ID NO: 2770 - protein, 122 aa, Artificial Sequence
  Description of Artificial Sequence: Synthetic polypeptide
EVTLRESGPALVKPTQTLTLTCTFSGFSLSTYGVSVGWIRQPPGKALEWLALIDWDDEKYYNPSLKNRLTISKDTSKNQVVLTMTNMDPVDTATYYCARIESIGTTYSFDYWGQGTMVTVSS

SEQ ID NO: 2771 - protein, 122 aa, Artificial Sequence
  Description of Artificial Sequence: Synthetic polypeptide
EVTLRESGPALVKPTQTLTLTCTFSGFSLSTSGVGVGWIRQPPGKALEWLALIDWIDDEDYSTSLKTRLTISKDTSKNQVVLTMTNMDPVDTATYYCARIESIGTTYSFDYWGQGTMVTVSS

SEQ ID NO: 2772 - protein, 122 aa, Artificial Sequence
  Description of Artificial Sequence: Synthetic polypeptide
EVTLRESGPALVKPTQTLTLTCTFSGFSLSTSGVSVRWIRQPPGKALEWLANIWWDDNKYYSTSLKTRLTISKDTSKNQVVLTMTNMDPVDTATYYCARIESIGTTYSFDYWGQGTMVTVSS

SEQ ID NO: 2773 - protein, 122 aa, Artificial Sequence
  Description of Artificial Sequence: Synthetic polypeptide
EVTLRESGPALVKPTQTLTLTCTFSGFSLCTSGMGVGWIRQPPGKALEWLANIWWDDDNYYSTSLKTRLTISKDTSKNQVVLTMTNMDPVDTATYYCARIESIGTTYSFDYWGQGTMVTVSS

SEQ ID NO: 2774 - protein, 122 aa, Artificial Sequence
  Description of Artificial Sequence: Synthetic polypeptide
EVTLRESGPALVKPTQTLTLTCTFSGFSLLTYGMGVGWIRQPPGKALEWLANIWWHDDKYYSTSLKTRLTISKDTSKNQVVLTMTNMDPVDTATYYCARIESIGTTYSFDYWGQGTMVTVSS

SEQ ID NO: 2775 - protein, 122 aa, Artificial Sequence
  Description of Artificial Sequence: Synthetic polypeptide
EVTLRESGPALVKPTQTLTLTCTFSGFSLSTSGVSVAWIRQPPGKALEWLANIWWDDDKYYSTSLKNRLTISKDTSKNQVVLTMTNMDPVDTATYYCARIESIGTTYSFDYWGQGTMVTVSS

SEQ ID NO: 2776 - protein, 122 aa, Artificial Sequence
  Description of Artificial Sequence: Synthetic polypeptide
EVTLRESGPALVKPTQTLTLTCTFSGFSLSTSGVRVGWIRQPPGKALEWLALIDWEDYLCYNPSLKNRLTISKDTSKNQVVLTMTNMDPVDTATYYCARIESIGTTYSFDYWGQGTMVTVSS

SEQ ID NO: 2777 - protein, 122 aa, Artificial Sequence
  Description of Artificial Sequence: Synthetic polypeptide
EVTLRESGPALVKPTQTLTLTCTFSGFSLSTSGVGVGWIRQPPGKALEWLALIDWDDDYYYSTSLKTRLTISKDTSKNQVVLTMTNMDPVDTATYYCARIESIGTTYSFDYWGQGTMVTVSS

SEQ ID NO: 2778 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYSTSLKTRLTISKDTSKNQVVLTMTNMDPVDTATYYCARIESIGTTYSFDYWGQGTMVTVSS

SEQ ID NO: 2779 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWVDDNYYSTSLKTRLTISKDTSKNQVVLTMTNMDPVDTATYYCARIESIGTTYSFDYWGQGTMVTVSS

SEQ ID NO: 2780 - protein, 122 aa, Artificial Sequence
  Description of Artificial Sequence: Synthetic polypeptide
EVTLRESGPALVKPTQTLTLTCTFSGFSLSTYGMGVYWIRQPPGKALEWLALIDWDDDNYYNPSLKNRLTISKDTSKNQVVLTMTNMDPVDTATYYCARIESIGTTYSFDYWGQGTMVTVSS

SEQ ID NO: 2781 - protein, 122 aa, Artificial Sequence
  Description of Artificial Sequence: Synthetic polypeptide
EVTLRESGPALVKPTQTLTLTCTFSGFSLSTSGVSVGWIRQPPGKALEWLALIDWDDGKYYSTSLKTRLTISKDTSKNQVVLTMTNMDPVDTATYYCARIESIGTTYSFDYWGQGTMVTVSS

SEQ ID NO: 2782 - protein, 122 aa, Artificial Sequence
  Description of Artificial Sequence: Synthetic polypeptide
EVTLRESGPALVKPTQTLTLTCTFSGFSLSTSGVRVVWIRQPPGKALEWLALIDWNDDKYYNPSLKNRLTISKDTSKNQVVLTMTNMDPVDTATYYCARIESIGTTYSFDYWGQGTMVTVSS

SEQ ID NO: 2783 - protein, 122 aa, Artificial Sequence
  Description of Artificial Sequence: Synthetic polypeptide
EVTLRESGPALVKPTQTLTLTCTFSGFSLSTSGVSVVWIRQPPGKALEWLANIWWHDDKYYSTSLKTRLTISKDTSKNQVVLTMTNMDPVDTATYYCARIESIGTTYSFDYWGQGTMVTVSS

SEQ ID NO: 2784 - protein, 122 aa, Artificial Sequence
  Description of Artificial Sequence: Synthetic polypeptide
EVTLRESGPALVKPTQTLTLTCTFSGFSLMTSGMSVCWIRQPPGKALEWLANIWWYDHKYYSTSLKTRLTISKDTSKNQVVLTMTNMDPVDTATYYCARIESIGTTYSFDYWGQGTMVTVSS

SEQ ID NO: 2785 - protein, 122 aa, Artificial Sequence
  Description of Artificial Sequence: Synthetic polypeptide
EVTLRESGPALVKPTQTLTLTCTFSGFSLRTYGVSVGWIRQPPGKALEWLANIWWDDAKYYSTSLKTRLTISKDTSKNQVVLTMTNMDPVDTATYYCARIESIGTTYSFDYWGQGTMVTVSS

SEQ ID NO: 2786 - protein, 122 aa, Artificial Sequence
  Description of Artificial Sequence: Synthetic polypeptide
EVTLRESGPALVKPTQTLTLTCTFSGFSLSTYGVRVAWIRQPPGKALEWLANIWWDDVKYYSTSLKTRLTISKDTSKNQVVLTMTNMDPVDTATYYCARIESIGTTYSFDYWGQGTMVTVSS

SEQ ID NO: 2787 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIAASYSFDYWGQGTMVTVSS

SEQ ID NO: 2788 - protein, 122 aa, Artificial Sequence
  Description of Artificial Sequence: Synthetic polypeptide
  MOD_RES (108)..(108): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARFEYLGAMYXFDYWGQGTMVTVSS

SEQ ID NO: 2789 - protein, 122 aa, Artificial Sequence
  Description of Artificial Sequence: Synthetic polypeptide
  MOD_RES (100)..(100): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARXDSFRKPYSFDYWGQGTMVTVSS

SEQ ID NO: 2790 - protein, 122 aa, Artificial Sequence
  Description of Artificial Sequence: Synthetic polypeptide
  MOD_RES (101)..(101): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIXSIGSTYWFDYWGQGTMVTVSS

SEQ ID NO: 2791 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLVSIVTKYSFDYWGQGTMVTVSS

SEQ ID NO: 2792 - protein, 122 aa, Artificial Sequence
  Description of Artificial Sequence: Synthetic polypeptide
  MOD_RES (1)..(1): Any amino acid
  MOD_RES (5)..(5): Any amino acid
  MOD_RES (12)..(12): Any amino acid
  MOD_RES (16)..(16): Any amino acid
  MOD_RES (28)..(28): Any amino acid
  MOD_RES (32)..(32): Any amino acid
  MOD_RES (48)..(48): Any amino acid
  MOD_RES (53)..(53): Any amino acid
  MOD_RES (66)..(66): Any amino acid
  MOD_RES (70)..(70): Any amino acid
  MOD_RES (94)..(94): Any amino acid
  MOD_RES (100)..(104): Any amino acid
  MOD_RES (106)..(106): Any amino acid
  MOD_RES (120)..(120): Any amino acid
  MOD_RES (122)..(122): Any amino acid
XVTLXESGPALXKPTXTLTLTCTFSGFXLSTXGMGVGWIRQPPRKALXWLANXWWDDDKYYNPSLXNRLXISKDTSKNQVVLTMTNMDPVDTAXYYCARXXXXXMXYSFDYWGQGTMVTXSX

SEQ ID NO: 2793 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLEPIPMTYSFDYWGQGTMVTVSS

SEQ ID NO: 2794 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEWSAITYSFDYWGQGTMVTVSS

SEQ ID NO: 2795 - protein, 122 aa, Artificial Sequence
  Description of Artificial Sequence: Synthetic polypeptide
  MOD_RES (104)..(104): Any amino acid
  MOD_RES (108)..(108): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIECTXNRYXFDYWGQGTMVTVSS

SEQ ID NO: 2796 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIECNSTTYSFDYWGQGTMVTVSS

SEQ ID NO: 2797 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLASLCATYYFDYWGQGTMVTVSS

SEQ ID NO: 2798 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIGWRLRMYSFDYWGQGTMVTVSS

SEQ ID NO: 2799 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSIGGTYSFDYWGQGTMVTVSS

SEQ ID NO: 2800 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVESIGTTYYFDYWGQGTMVTVSS

SEQ ID NO: 2801 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARYAPIGTTYWFDYWGQGTMVTVSS

SEQ ID NO: 2802 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTRTTYLFDYWGQGTMVTVSS

SEQ ID NO: 2803 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGTAYSFDYWGQGTMVTVSS

SEQ ID NO: 2804 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIASVGTSYSFDYWGQGTMVTVSS

SEQ ID NO: 2805 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCAREESTCPTYYFDYWGQGTMVTVSS

SEQ ID NO: 2806 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARTESIDRAYSFDYWGQGTMVTVSS

SEQ ID NO: 2807 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIGSTGISYSFDYWGQGTMVTVSS

SEQ ID NO: 2808 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARRESIGTTYSFDYWGQGTMVTVSS

SEQ ID NO: 2809 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARKVTIETAYYFDYWGQGTMVTVSS

SEQ ID NO: 2810 - protein, 122 aa, Artificial Sequence
  Description of Artificial Sequence: Synthetic polypeptide
  MOD_RES (95)..(95): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATXYCARFASIGTTYSFDYWGQGTMVTVSS

SEQ ID NO: 2811 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARMKSIATTYSFDYWGQGTMVTVSS

SEQ ID NO: 2812 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRRATYSFDYWGQGTMVTVSS

SEQ ID NO: 2813 - protein, 122 aa, Artificial Sequence
  Description of Artificial Sequence: Synthetic polypeptide
  MOD_RES (102)..(102): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIGXIGSAYTFDYWGQGTMVTVSS

SEQ ID NO: 2814 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARTGSGVTTYSFDYWGQGTMVTVSS

SEQ ID NO: 2815 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIGSIESAYSFDYWGQGTMVTVSS

SEQ ID NO: 2816 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVYSKGTTYSFDYWGQGTMVTVSS

SEQ ID NO: 2817 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARFEALGLSYSFDYWGQGTMVTVSS

SEQ ID NO: 2818 - protein, 122 aa, Artificial Sequence
  Description of Artificial Sequence: Synthetic polypeptide
  MOD_RES (95)..(95): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATXYCARRGTIRTTYSFDYWGQGTMVTVSS

SEQ ID NO: 2819 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIYWIGPTYCFDYWGQGTMVTVSS

SEQ ID NO: 2820 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMRTTYSFDYWGQGTMVTVSS

SEQ ID NO: 2821 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIRSIVTTYSFDYWGQGTMVTVSS

SEQ ID NO: 2822 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARTQSSAMTYSFDYWGQGTMVTVSS

SEQ ID NO: 2823 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARNESMGTSYSFDYWGQGTMVTVSS

SEQ ID NO: 2824 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEFVRAIYSFDYWGQGTMVTVSS

SEQ ID NO: 2825 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARFESLGETYSFDYWGQGTMVTVSS

SEQ ID NO: 2826 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEAIGNQYSFDYWGQGTMVTVSS

SEQ ID NO: 2827 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARKDSMVTTYLFDYWGQGTMVTVSS

SEQ ID NO: 2828 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVEWQGSTYSFDYWGQGTMVTVSS

SEQ ID NO: 2829 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYMFDYWGQGTMVTVSS

SEQ ID NO: 2830 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARCASVSTTYCFDYWGQGTMVTVSS

SEQ ID NO: 2831 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARILSIGNTYSFDYWGQGTMVTVSS

SEQ ID NO: 2832 - protein, 122 aa, Artificial Sequence
  Description of Artificial Sequence: Synthetic polypeptide
EVTLRESGPALVKPTQTLTLTCTFFGFSLSTYGMGVGWIRQPPGKALEWLANIWCDDDKYYNPSLKNRLTISKDTSKNQVVLTMTNMDPVDTATYYCARIESNGNTYSFDYWGQGTMVTVSS

SEQ ID NO: 2833 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARRDSTGTPYSFDYWGQGTMVTVSS

SEQ ID NO: 2834 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVESIVTTYYFDYWGQGTMVTVSS

SEQ ID NO: 2835 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLEKFGRTYPFDYWGQGTMVTVSS

SEQ ID NO: 2836 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARFKSNRPSYSFDYWGQGTMVTVSS

SEQ ID NO: 2837 - protein, 122 aa, Artificial Sequence
  Description of Artificial Sequence: Synthetic polypeptide
  MOD_RES (65)..(65): Any amino acid
  MOD_RES (70)..(70): Any amino acid
  MOD_RES (108)..(108): Any amino acid
  MOD_RES (111)..(112): Any amino acid
  MOD_RES (116)..(116): Any amino acid
  MOD_RES (118)..(118): Any amino acid
EVTLRESGPALVKPTQTLTLTCTFSGFSLSTYGMGVGWIRQPPGKALEWLANIWWDDDKYYNPSXKNRLXISKDTSKNQVVLTMTNMDPVDTATYYCARIESLDTTYXFDXXGQGXMXTVSS

SEQ ID NO: 2838 - protein, 122 aa, Artificial Sequence
  Description of Artificial Sequence: Synthetic polypeptide
  MOD_RES (101)..(101): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIXATGMLYSFDYWGQGTMVTVSS

SEQ ID NO: 2839 - protein, 122 aa, Artificial Sequence
  Description of Artificial Sequence: Synthetic polypeptide
  MOD_RES (108)..(108): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIETTYXFDYWGQGTMVTVSS

SEQ ID NO: 2840 - protein, 122 aa, Artificial Sequence
  Description of Artificial Sequence: Synthetic polypeptide
  MOD_RES (102)..(102): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEXMAPMYSFDYWGQGTMVTVSS

SEQ ID NO: 2841 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVRPLVTIYSFDYWGQGTMVTVSS

SEQ ID NO: 2842 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIDSVWTTYSFDYWGQGTMVTVSS

SEQ ID NO: 2843 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVEEIGNTYNFDYWGQGTMVTVSS

SEQ ID NO: 2844 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARRGLFRIRYSFDYWGQGTMVTVSS

SEQ ID NO: 2845 - protein, 122 aa, Artificial Sequence
  Description of Artificial Sequence: Synthetic polypeptide
  MOD_RES (69)..(69): Any amino acid
EVTLRESGPALVKPTQTLTLTCTFSGFSLSTYGMGVGWIRQPPGKALEWLANIWWDDDKYYNPSLKNRXTISKDTSKNQVVLTMTNMDPVDTATYYCARIESIGTTYSFDYWGQGTMVTVSS

SEQ ID NO: 2846 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEVIGTAYSFDYWGQGTMVTVSS

SEQ ID NO: 2847 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLDVIGMLYAFDYWGQGTMVTVSS

SEQ ID NO: 2848 - protein, 122 aa, Artificial Sequence
  Description of Artificial Sequence: Synthetic polypeptide
  MOD_RES (108)..(108): Any amino acid
EVTLRESGPALVKPTKTLTLTCTFSGFSLSTYGMGVGWIRQPPGKALEWLANIWWDDDKYYNPSLKNRLTISKDTSKNQVVLTMTNMDPVDTATYYCARIMSIGSSYXFDYWGQGTMVTVSS

SEQ ID NO: 2849 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIDWIGTTYSFDYWGQGTMVTVSS

SEQ ID NO: 2850 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARNSSIGSTYSFDYWGQGTMVTVSS

SEQ ID NO: 2851 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESPGTWYSFDYWGQGTMVTVSS

SEQ ID NO: 2852 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEWIGITYCFDYWGQGTMVTVSS

SEQ ID NO: 2853 - protein, 122 aa, Artificial Sequence
  Description of Artificial Sequence: Synthetic polypeptide
  MOD_RES (102)..(102): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEXLGTTYSFDYWGQGTMVTVSS

SEQ ID NO: 2854 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARKELTCSTYSFDYWGQGTMVTVSS

SEQ ID NO: 2855 - protein, 122 aa, Artificial Sequence
  Description of Artificial Sequence: Synthetic polypeptide
  MOD_RES (102)..(102): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEXIRMRYSFDYWGQGTMVTVSS

SEQ ID NO: 2856 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARKAAIATLYLFDYWGQGTMVTVSS

SEQ ID NO: 2857 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARRRPIVTTYSFDYWGQGTMVTVSS

SEQ ID NO: 2858 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTVYSFDYWGQGTMVTVSS

SEQ ID NO: 2859 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIASIGSMYSFDYWGQGTMVTVSS

SEQ ID NO: 2860 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRATTYSFDYWGQGTMVTVSS

SEQ ID NO: 2861 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARNVWLGTTYSFDYWGQGTMVTVSS

SEQ ID NO: 2862 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIMSIGTAYSFDYWGQGTMVTVSS

SEQ ID NO: 2863 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIKWIWTTYSFDYWGQGTMVTVSS

SEQ ID NO: 2864 - protein, 122 aa, Artificial Sequence
  Description of Artificial Sequence: Synthetic polypeptide
  MOD_RES (102)..(102): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEXRGSTYIFDYWGQGTMVTVSS

SEQ ID NO: 2865 - protein, 122 aa, Artificial Sequence
  Description of Artificial Sequence: Synthetic polypeptide
  MOD_RES (98)..(98): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCXRIESIGTTYSFDYWGQGTMVTVSS

SEQ ID NO: 2866 - protein, 122 aa, Artificial Sequence
  Description of Artificial Sequence: Synthetic polypeptide
  MOD_RES (87)..(87): Any amino acid
EVTLRESGPALVKPTQTLTLTCTFSGFSLSTYGMGVGWIRQPPGKALEWLANIWWDDDKYYNPSLKNRLTISKDTSKNQVVLTMTNXDPVDTATYYCARIESIGTTYSFDYWGQGTMVTVSS

SEQ ID NO: 2867 - protein, 122 aa, Artificial Sequence
  Description of Artificial Sequence: Synthetic polypeptide
  MOD_RES (108)..(108): Any amino acid
  MOD_RES (110)..(110): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYXFXYWGQGTMVTVSS

SEQ ID NO: 2868 - protein, 122 aa, Artificial Sequence
  Description of Artificial Sequence: Synthetic polypeptide
  MOD_RES (95)..(95): Any amino acid
  MOD_RES (112)..(112): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATXYCARIESIGTTYSFDYXGQGTMVTVSS

SEQ ID NO: 2869 - protein, 122 aa, Artificial Sequence
  Description of Artificial Sequence: Synthetic polypeptide
  MOD_RES (99)..(99): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCAXIESIGTTYSFDYWGQGTMVTVSS

SEQ ID NO: 2870 - protein, 122 aa, Artificial Sequence
  Description of Artificial Sequence: Synthetic polypeptide
  MOD_RES (96)..(96): Any amino acid
  MOD_RES (109)..(109): Any amino acid
  MOD_RES (117)..(117): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYXCARIESIGTTYSXDYWGQGTXVTVSS

SEQ ID NO: 2871 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKNRLTISKDTSKNQVVLTMTNMDPVDTATYYCARIESIGTTYSFDYWGQGTMVTVSS

SEQ ID NO: 2872 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNVDPVDTATYYCARIESIGTTYSFDYWGQGTMVTVSS

SEQ ID NO: 2873 - protein, 122 aa, Artificial Sequence
  Description of Artificial Sequence: Synthetic polypeptide
EVTLRESGPALVKPTQTLTLTCTFSGFSLSTYGMGVGWIRQPPGKELEWLANIWWDDDKYYNPSLKNRLTISKDTSKNQVVLTMTNMDPVDTATYYCARIESIGTTYSFDYWGQGTMVTVSS

SEQ ID NO: 2874 - protein, 122 aa, Artificial Sequence
  Description of Artificial Sequence: Synthetic polypeptide
EVTLRESGPALVKPTQTLTLTCTFSGFSLATSGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2875 - protein, 122 aa, Artificial Sequence
  Description of Artificial Sequence: Synthetic polypeptide
EVTLRESGPALVKPTQTLTLTCTFSGFRLSTYGMGVGWIRKPPGKALEWLANIWWDDDKYYNPSLKNRLTISKDTSKNQVVLTMTNMDPVDTATYYCARIESIGTTYSFDYWGQGTMVTVSS

SEQ ID NO: 2876 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTANYYCARIASIPTMYAFDYWGQGTMVTVSS

SEQ ID NO: 2877 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWMANIWWDDDKYYNPSLKNRLTISKDTSKNQVVLTMTNMDPVDTATYYCARIESIGTTYSFDYWGQGTMVTVSS

SEQ ID NO: 2878 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDHDKYYNPSLKNRLTISKDTSKNQVVLTMTNMDPVDTATYYCARIESIGTTYSFDYWGQGTMVTVSS

SEQ ID NO: 2879 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDKYYNPSLKTRLTISKDTSKNQVVLTMTNMDPVDTATYYCARIESIGTTYSFDYWGQGTMVTVSS

SEQ ID NO: 2880 - protein, 122 aa, Artificial Sequence
  Description of Artificial Sequence: Synthetic polypeptide
EVTLRESGPALVKPTQTLTLTCTFSGFSLSTYGVGVGWIRQPPGKALEWLANIWWDDDKYYSTSLKTRLTISKDTSKNQVVLTMTNMDPVDTATYYCARIESIGTTYSFDYWGQGTMVTVSS

SEQ ID NO: 2881 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKTRLTISKDTSKNQVVLTMTNMDPVDTATYYCARIESIGTTYSFDYWGQGTMVTVSS

SEQ ID NO: 2882 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDRYYNPSLKNRLTISKDTSKNQVVLTMTNMDPVDTATYYCARIESIGTTYSFDYWGQGTMVTVSS

SEQ ID NO: 2883 - protein, 122 aa, Artificial Sequence
  Description of Artificial Sequence: Synthetic polypeptide
EVTLRESGPALVKPTQTLTLTCTFSGFSLMTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2884 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNTSLKNRLTISKDTSKNQVVLTMTNMDPVDTATYYCARIESIGTTYSFDYWGQGTMVTVSS

SEQ ID NO: 2885 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLENIWWDDDKYYNPSLKNRLTISKDTSKNQVVLTMTNMDPVDTATYYCARIESIGTTYSFDYWGQGTMVTVSS

SEQ ID NO: 2886 - protein, 122 aa, Artificial Sequence
  Description of Artificial Sequence: Synthetic polypeptide
  MOD_RES (15)..(15): Any amino acid
  MOD_RES (41)..(41): Any amino acid
  MOD_RES (72)..(72): Any amino acid
EVTLKKSGPALVKPXQTLTLTCTFSGFSLSTYGMGVGWIRXPPGKGLEWLANIWWDDDKYYNPSLKNRLTIXKDTSKNQVVLTMTNMDPVDTATYYCARIESIGTTYSFDYWGQGTMVTVSS

SEQ ID NO: 2887 - protein, 122 aa, Artificial Sequence
  Description of Artificial Sequence: Synthetic polypeptide
  MOD_RES (16)..(16): Any amino acid
EVTLKESGPALVKPTXTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2888 - protein, 122 aa, Artificial Sequence
  Description of Artificial Sequence: Synthetic polypeptide
  MOD_RES (122)..(122): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSX

SEQ ID NO: 2889 - protein, 122 aa, Artificial Sequence
  Description of Artificial Sequence: Synthetic polypeptide
  MOD_RES (16)..(16): Any amino acid
EVTLRESGPALVKPTXTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2890 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARMKSIGSTYSFDYWGQGTMVTVSS

SEQ ID NO: 2891 - protein, 122 aa, Artificial Sequence
  Description of Artificial Sequence: Synthetic polypeptide
EVTLKESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2892 - protein, 122 aa, Artificial Sequence
  Description of Artificial Sequence: Synthetic polypeptide
  MOD_RES (16)..(16): Any amino acid
  MOD_RES (116)..(116): Any amino acid
EVTLRESGPALVKPTXTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGXMVTVSS

SEQ ID NO: 2893 - protein, 122 aa, Artificial Sequence
  Description of Artificial Sequence: Synthetic polypeptide
  MOD_RES (16)..(16): Any amino acid
EVTLKESGPALVKPTXTLTLTCTFSGFSLSTYGMGVGWIRHPPGKALEWLANIWWNNDNYYNPSLKNRLTINKDTSKNQVVLTMTNMDPVDTATYYCARIESIGTTYSFDYWGQGTMVTVSS

SEQ ID NO: 2894 - protein, 122 aa, Artificial Sequence
  Description of Artificial Sequence: Synthetic polypeptide
EVTLKESGPALVKPTQTLTLTCTFSGFSLSTYGMGVGWIRQPPGKALEGLANIWWDDDKYYNPSLKNRLTINKDTSKNQVVLTMTNMDPVDTATYYCARIESIGTTYSFDYWGQGTMVTVSS

SEQ ID NO: 2895 - protein, 122 aa, Artificial Sequence
  Description of Artificial Sequence: Synthetic polypeptide
EVTLRESGPALVKPTHTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2896 - protein, 122 aa, Artificial Sequence
  Description of Artificial Sequence: Synthetic polypeptide
EVTLKESGPALVKPTQTLTLTCTFSGFRLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2897 - protein, 122 aa, Artificial Sequence
  Description of Artificial Sequence: Synthetic polypeptide
  MOD_RES (5)..(5): Any amino acid
  MOD_RES (16)..(16): Any amino acid
EVTLXESGPALVKPTXTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 2898 - protein, 122 aa, Artificial Sequence
  Description of Artificial Sequence: Synthetic polypeptide
EVTLKESGPALVKPTQTLTLTCTFSGFSLSTYGMGVGWIRQPPGKALEWLANIWWDDDKYYNPSLKNRLTINKDTSKNQVVLTMTNMDPVDTATYYCARIESIGTTYSFDYWGQGTMVTVSS

SEQ ID NO: 2899 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESGWTTYSFDYWGQGTMVTVSS

SEQ ID NO: 2900 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIWTSYSFDYWGQGTMVTVSS

SEQ ID NO: 2901 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSSWTIYSFDYWGQGTMVTVSS

SEQ ID NO: 2902 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIYSSGTVYSFDYWGQGTMVTVSS

SEQ ID NO: 2903 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGISYSFDYWGQGTMVTVSS

SEQ ID NO: 2904 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGTSYSFDYWGQGTMVTVSS

SEQ ID NO: 2905 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGPSYSFDYWGQGTMVTVSS

SEQ ID NO: 2906 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGSSYSFDYWGQGTMVTVSS

SEQ ID NO: 2907 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSIGWSYSFDYWGQGTMVTVSS

SEQ ID NO: 2908 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIYSDWTIYSFDYWGQGTMVTVSS

SEQ ID NO: 2909 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWITYSFDYWGQGTMVTVSS

SEQ ID NO: 2910 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESEWTTYNFDYWGQGTMVTVSS

SEQ ID NO: 2911 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPTTYSFDYWGQGTMVTVSS

SEQ ID NO: 2912 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGISYSFDYWGQGTMVTVSS

SEQ ID NO: 2913 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSATIYSFDYWGQGTMVTVSS

SEQ ID NO: 2914 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGTTYSFDYWGQGTMVTVSS

SEQ ID NO: 2915 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTSYSFDYWGQGTMVTVSS

SEQ ID NO: 2916 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSTWTTYSFDYWGQGTMVTVSS

SEQ ID NO: 2917 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGTSYNFDYWGQGTMVTVSS

SEQ ID NO: 2918 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTWWTYSFDYWGQGTMVTVSS

SEQ ID NO: 2919 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGWSYAFDYWGQGTMVTVSS

SEQ ID NO: 2920 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGYSYSFDYWGQGTMVTVSS

SEQ ID NO: 2921 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWMANIWWDDDKYYNPSLKNRLTISKDTSKNQVVLTMTNMDPVDTATYYCARIETLGISYSFDYWGQGTMVTVSS

SEQ ID NO: 2922 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMWSSYSFDYWGQGTMVTVSS

SEQ ID NO: 2923 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETIGTSYSFDYWGQGTMVTVSS

SEQ ID NO: 2924 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSDVTTYSFDYWGQGTMVTVSS

SEQ ID NO: 2925 - protein, 122 aa, Artificial Sequence
  Description of Artificial Sequence: Synthetic polypeptide
EVTLRESGPALVKPTKTLTLTCTFSGFSLSTYGMGVGWIRQPPGKALEWLANIWWDDDKYYNPSLKNRLTISKDTSKNQVVLTMTNMDPVDTATYYCARIESFGTSYSFDYWGQGTMVTVSS

SEQ ID NO: 2926 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIKSIGWTYSFDYWGQGTMVTVSS

SEQ ID NO: 2927 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNFWSYSFDYWGQGTMVTVSS

SEQ ID NO: 2928 - protein, 122 aa, Artificial Sequence
  Description of Artificial Sequence: Synthetic polypeptide
EVTLRESGPALVKPTHTLTLTCTFSGFSLSTYGMGVGWIRQPPGKALEWLANIWWDDDKYYNPSLKNRLTISKDTSKNQVVLTMTNMDPVDTATYYCARIMSLETRYDFYYWGQGTMVTVSS

SEQ ID NO: 2929 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVETSYNFDYWGQGTMVTVSS

SEQ ID NO: 2930 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESFWTTYSFDYWGQGTMVTVSS

SEQ ID NO: 2931 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGTSYSFDYWGQGTMVTVSS

SEQ ID NO: 2932 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIWSSYSFDYWGQGTMVTVSS

SEQ ID NO: 2933 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGFSYSFDYWGQGTMVTVSS

SEQ ID NO: 2934 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVGPSYSFDYWGQGTMVTVSS

SEQ ID NO: 2935 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGWTYSFDYWGQGTMVTVSS

SEQ ID NO: 2936 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESDWTTYSFDYWGQGTMVTVSS

SEQ ID NO: 2937 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGPSYSFDYWGQGTMVTVSS

SEQ ID NO: 2938 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLVTSYDFDYWGQGTMVTVSS

SEQ ID NO: 2939 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVGTSYNFDYWGQGTMVTVSS

SEQ ID NO: 2940 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTEASYSFDYWGQGTMVTVSS

SEQ ID NO: 2941 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNGASYSFDYWGQGTMVTVSS

SEQ ID NO: 2942 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSVTTYSFDYWGQGTMVTVSS

SEQ ID NO: 2943 - protein, 122 aa, Artificial Sequence
  Description of Artificial Sequence: Synthetic polypeptide
  MOD_RES (100)..(100): Any amino acid
  MOD_RES (103)..(103): Any amino acid
EVTLRESGPALVKPTQTLTLTCTFSGFSLSTYGMGVGWIRQPPGKALEWLANIWWDDDNYYNPSLKNRLTISKDTSKNQVVLTMTNMDPVDTATYYCARXESXWTSYSFDYWGQGTMVTVSS

SEQ ID NO: 2944 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGASYSFDYWGQGTMVTVSS

SEQ ID NO: 2945 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGRSYGFDYWGQGTMVTVSS

SEQ ID NO: 2946 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETLGTSYSFDYWGQGTMVTVSS

SEQ ID NO: 2947 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGTTYSFDYWGQGTMVTVSS

SEQ ID NO: 2948 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIPTAYSFDYWGQGTMVTVSS

SEQ ID NO: 2949 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKTRLTISKDTSKNQVVLTMTNMDPVDTATYYCARIESLGTTYSFDYWGQGTMVTVSS

SEQ ID NO: 2950 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLESIATTYSFDYWGQGTMVTVSS

SEQ ID NO: 2951 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGPSYSFDYWGHGTMVTVSS

SEQ ID NO: 2952 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSYTSYSFDYWGQGTMVTVSS

SEQ ID NO: 2953 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTWTSYSFDYWGQGTMVTVSS

SEQ ID NO: 2954 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSVTNYQFDYWGQGTMVTVSS

SEQ ID NO: 2955 - protein, 122 aa, Artificial Sequence
  Description of Artificial Sequence: Synthetic polypeptide
EVTLRESGPALVKPTQTLTLICTFSGFSLSTYGMGVGWIRQPPGKALEWLANIWWDDDKYYNPSLKNRLTISKDTSKNQVVLTMTNMDPVDTATYYCARIESIGTSYSFDYWGQGTMVTVSS

SEQ ID NO: 2956 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGPAYSFDYWGQGTMVTVSS

SEQ ID NO: 2957 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSNNQVVLTMTNMDPVDTATYYCARIESFGSSYSFDYWGQGTMVTVSS

SEQ ID NO: 2958 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSETTYTFDYWGQGTMVTVSS

SEQ ID NO: 2959 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIWTTYSFDYWGQGTMVTVSS

SEQ ID NO: 2960 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNLLTISKDTSKNQVVLTMTNMDPVDTATYYCARIESFGTSYSFDYWGQGTMVTVSS

SEQ ID NO: 2961 - protein, 122 aa, Artificial Sequence
  Description of Artificial Sequence: Synthetic polypeptide
  MOD_RES (103)..(103): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIASXGTSYSFDYWGQGTMVTVSS

SEQ ID NO: 2962 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDEKYYSTSLKTRLTISKDTSKNQVVLTMTNMDPVDTATYYCARIESIGTSYSFDYWGQGTMVTVSS

SEQ ID NO: 2963 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPTSYSFDYWGQGTMVTVSS

SEQ ID NO: 2964 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDKYYNPSLKNRLTISKDTSKNQVVLTMTNMDPVDTATYYCARIESIGWSYAFDYWGQGTMVTVSS

SEQ ID NO: 2965 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKTRLTISKDTSKNQVVLTMTNMDPVDTATYYCARIESIGWTYSFDYWGQGTMVTVSS

SEQ ID NO: 2966 - protein, 122 aa, Artificial Sequence
  Description of Artificial Sequence: Synthetic polypeptide
  MOD_RES (59)..(59): Any amino acid
EVTLRESGPALVKPTQTLTLTCTFSGFSLATSGVSVLWIRQPPGKALEWLANIWWDDGXYYSTSLKTRLTISKDTSKNQVVLTMTNMDPVDTATYYCARIESFGTSYSFDYWGQGTMVTVSS

SEQ ID NO: 2967 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLWTTYSFDYWGQGTMVTVSS

SEQ ID NO: 2968 - protein, 122 aa, Artificial Sequence
  Description of Artificial Sequence: Synthetic polypeptide
EVTLRESGPALVKPTQTLTLTCTFSGFSLDTYGMGVGWIRQPPGKALEWLANIWWDDDKYYSTSLKTRLTISKDTSKNQVVLTMTNMDPVDTATYYCARIESSGYTYSFDYWGQGTMVTVSS

SEQ ID NO: 2969 - protein, 122 aa, Artificial Sequence
  Description of Artificial Sequence: Synthetic polypeptide
EVTLRESGPALVKPTQTLTLTCTFSGFSLTTYGMGVGWIRQPPGKALEWLANIWWDDDKYYNPSLKNRLTISKDTSKNQVVLTMTNMDPVDTATYYCARIESSGSSYSFDYWGQGTMVTVSS

SEQ ID NO: 2970 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARVASSWVEYSFDYWGQGTMVTVSS

SEQ ID NO: 2971 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESFGTSYSFDYWGQGTMVTVSS

SEQ ID NO: 2972 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGTTYSFDYWGQGTMVTVSS

SEQ ID NO: 2973 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKNRLTISKDTSKNQVVLTMTNMDPVDTATYYCARIESMGISYSFDYWGQGTMVTVSS

SEQ ID NO: 2974 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGIAYSFDYWGQGTMVTVSS

SEQ ID NO: 2975 - protein, 122 aa, Artificial Sequence
  Description of Artificial Sequence: Synthetic polypeptide
  MOD_RES (54)..(54): Any amino acid
EVTLRESGPALVKPTQTLTLTCTFSGFSLSTYGMGVGWIRQPPGKALEWLANIXWDDDKYYNPSLKNRLTISKDTSKNQVVLTMTNMDPVDTATYYCARIESIVTTYSFDYWGQGTMVTVSS

SEQ ID NO: 2976 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESGWTIYSFDYWGQGTMVTVSS

SEQ ID NO: 2977 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGPTYSFDYWGQGTMVTVSS

SEQ ID NO: 2978 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVGTSYSFDYWGQGTMVTVSS

SEQ ID NO: 2979 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDQYYNPSLKNRLTISKDTSKNQVVLTMTNMDPVDTATYYCARIESSWTTYSFDYWGQGTMVTVSS

SEQ ID NO: 2980 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESFGPSYSFDYWGQGTMVTVSS

SEQ ID NO: 2981 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGTSYSFDYWGQGTMVTVSS

SEQ ID NO: 2982 - protein, 122 aa, Artificial Sequence
  Description of Artificial Sequence: Synthetic polypeptide
  MOD_RES (100)..(101): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARXXSIVTTYSFDYWGQGTMVTVSS

SEQ ID NO: 2983 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYSTSLKTRLTISKDTSKNQVVLTMTNMDPVDTATYYCARIESIGTSYSFDYWGQGTMVTVSS

SEQ ID NO: 2984 - protein, 122 aa, Artificial Sequence
  Description of Artificial Sequence: Synthetic polypeptide
EVTLRESGPALVKPTQTLTLTCTFSGFSLSTYGMGVGLIRQPPGKALEWLANIWWDDDKYYNPSLKNRLTISKDTSKNQVVLTMTNMDPVDTATYYCARIESVGTSYSFDYWGQGTMVTVSS

SEQ ID NO: 2985 - protein, 122 aa, Artificial Sequence
  Description of Artificial Sequence: Synthetic polypeptide
EVTLKESGPALVKPTQTLTLTCTFSGFSLSTYGMGVGWIRQPPGKALEWLANIWWDDDKYYNPSLKNRLTISKDTSKNQVVLTMTNMDPVDTATYYCARIGSSGTTYSFDYWGQGTMVTVSS

SEQ ID NO: 2986 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNTSLKNRLTISKDTSKNQVVLTMTNMDPVDTATYYCARIDSFGAIYSFDYWGQGTMVTVSS

SEQ ID NO: 2987 - protein, 122 aa, Artificial Sequence
  Description of Artificial Sequence: Synthetic polypeptide
EVTLRESGPALVKPTQTLTLTCTFSGFSLSTYGMGVGWIRQPPGKELEWLANIWWDDDKYYNPSLKNRLTISKDTSKNQVVLTMTNMDPVETATYYCARIESIGTAYNFDYWGQGTMVTVSS

SEQ ID NO: 2988 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGTSYSFDYWGQGTMFTVSS

SEQ ID NO: 2989 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDKYYNPSLKNRLTISKDTSKNQVVLTMTNMDPVDTATYYCARIESLGTSYSFDYWGQGTMVTVSS

SEQ ID NO: 2990 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIEAKGTTYSFDYWGQGTMVTVSS

SEQ ID NO: 2991 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRGTSYSFDYWGQGTMVTVSS

SEQ ID NO: 2992 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGPTYSFDYWGQGTMVTVSS

SEQ ID NO: 2993 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIETSYSFDYWGQGTMVTVSS

SEQ ID NO: 2994 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYRARIESLGTTYSFDYWGQGTMVTVSS

SEQ ID NO: 2995 - protein, 122 aa, Artificial Sequence
  Description of Artificial Sequence: Synthetic polypeptide
EVTLRESGPALVKPTQTLTLTCTFSGFSLSTYGMGVGWIRHPPGKALEWLANIWWDDDKYYNPSLKNRLTISKDTSKNQVVLTMTNMDPVDTATYYCARIESMGTSYSFDYWGQGTMVTVSS

SEQ ID NO: 2996 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGTTYSFDYWGQGTMVTVSS

SEQ ID NO: 2997 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCALIESSGTTYSFDYWGQGTMVTVSS

SEQ ID NO: 2998 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESKGVSYSFDYWGQGTMVTVSS

SEQ ID NO: 2999 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIPTTYSFDYWGQGTMVTVSS

SEQ ID NO: 3000 - protein, 122 aa, Artificial Sequence
  Description of Artificial Sequence: Synthetic polypeptide
  MOD_RES (8)..(8): Any amino acid
EVTLRESXPALVKPTQTLTLTCTFSGFSLSTYGMGVGWIRQPPGKELEWLANIWWDDDKYYNPSLKNRLTISKDTSKNQVVLTMTNMDPVDTATYYCARIESLGTTYSFDYWGQGTMVTVSS

SEQ ID NO: 3001 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGITYSFDYWGQGTMVTVSS

SEQ ID NO: 3002 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGRSYSFDYWGQGTMVTVSS

SEQ ID NO: 3003 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIATSYSFDYWGQGTMVTVSS

SEQ ID NO: 3004 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYNFDYWGQGTMVTVSS

SEQ ID NO: 3005 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGPMYSFDYWGQGTMVTVSS

SEQ ID NO: 3006 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTAYSFDYWGQGTMVTVSS

SEQ ID NO: 3007 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARMESSWTTYSFDYWGQGTMVTVSS

SEQ ID NO: 3008 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGATYSFDYWGQGTMVTVSS

SEQ ID NO: 3009 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGPKYSFDYWGQGTMVTVSS

SEQ ID NO: 3010 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMGMSYSFDYWGQGTMVTVSS

SEQ ID NO: 3011 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGLSYSFDYWGQGTMVTVSS

SEQ ID NO: 3012 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYRARIESLGMSYSFDYWGQGTMVTVSS

SEQ ID NO: 3013 - protein, 122 aa, Artificial Sequence
  Description of Artificial Sequence: Synthetic polypeptide
  MOD_RES (101)..(101): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARLXSTGTNYSFDYWGQGTMVTVSS

SEQ ID NO: 3014 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSDTIYSFDYWGQGTMVTVSS

SEQ ID NO: 3015 - protein, 122 aa, Artificial Sequence
  Description of Artificial Sequence: Synthetic polypeptide
EVTLRESGPALVKPTQTLTLTCTFSGFSLSTSGMGVDWIRQPPGKALEWLALIDWDDDIHYNPSLKNRLTISKDTSKNQVVLTMTNMDPVDTATYYCARIESIGTTYSFDYWGQGTMVTVSS

SEQ ID NO: 3016 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVGTTYSFDYWGQGTMVTVSS

SEQ ID NO: 3017 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWYDDKYYNPSLKNRLTISKDTSKNQVVLTMTNMDPVDTATYYCARIESTGTTYSFDYWGQGTMVTVSS

SEQ ID NO: 3018 - protein, 122 aa, Artificial Sequence
  Description of Artificial Sequence: Synthetic polypeptide
  MOD_RES (108)..(108): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARNESFGRMYXFDYWGQGTMVTVSS

SEQ ID NO: 3019 - protein, 122 aa, Artificial Sequence
  Description of Artificial Sequence: Synthetic polypeptide
  MOD_RES (100)..(100): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARXESIGTTYSFDYWGQGTMVTVSS

SEQ ID NO: 3020 - protein, 122 aa, Artificial Sequence
  Description of Artificial Sequence: Synthetic polypeptide
EVTLRESGPSLVKPTQTLTLTCTFSGFSLSTYGMGVGWIRQPPGKALEWLANIWWDDDKYYNPSLKNRLTISKDTSKNQVVLTMTNMDPVDTATYYCARIESFGTTYSFDYWGQGTMVTVSS

SEQ ID NO: 3021 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETLGTAYSFDYWGQGTMVTVSS

SEQ ID NO: 3022 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESFGSSYSFDYWGQGTMVTVSS

SEQ ID NO: 3023 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESGPTTYSFDYWGQGTMVTVSS

SEQ ID NO: 3024 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTMYSFDYWGQGTMVTVSS

SEQ ID NO: 3025 - protein, 122 aa, Artificial Sequence
  Description of Artificial Sequence: Synthetic polypeptide
  MOD_RES (104)..(104): Any amino acid
  MOD_RES (109)..(109): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTXTTYSXDYWGQGTMVTVSS

SEQ ID NO: 3026 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGITYSFDYWGQGTMVTVSS

SEQ ID NO: 3027 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESMETTYSFDYWGQGTMVTVSS

SEQ ID NO: 3028 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNAITYSFDYWGQGTMVTVSS

SEQ ID NO: 3029 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSETTYMFDYWGQGTMVTVSS

SEQ ID NO: 3030 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLTNIWWDDDKYYNPSLKNRLTISKDTSKNQVVLTMTNMDPVDTATYYCARIESMGTSYSFDYWGQGTMVTVSS

SEQ ID NO: 3031 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIYSIGTSYSFDYWGQGTMVTVSS

SEQ ID NO: 3032 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPWTYSFDYWGQGTMVTVSS

SEQ ID NO: 3033 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRPDTYSFDYWGQGTMVTVSS

SEQ ID NO: 3034 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSSASNYEFDYWGQGTMVTVSS

SEQ ID NO: 3035 - protein, 122 aa, Artificial Sequence
  Description of Artificial Sequence: Synthetic polypeptide
  MOD_RES (107)..(107): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSGWTNXEFDYWGQGTMVTVSS

SEQ ID NO: 3036 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSIWTRYDFDYWGQGTMVTVSS

SEQ ID NO: 3037 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSFATNYEFDYWGQGTMVTVSS

SEQ ID NO: 3038 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVPWSYSFDYWGQGTMVTVSS

SEQ ID NO: 3039 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTPFSYSFDYWGQGTMVTVSS

SEQ ID NO: 3040 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYDFDYWGQGTMVTVSS

SEQ ID NO: 3041 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSSSTNYEFDYWGQGTMVTVSS

SEQ ID NO: 3042 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSSWRRYEFDYWGQGTMVTVSS

SEQ ID NO: 3043 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIKTSATNYDFDYWGQGTMVTVSS

SEQ ID NO: 3044 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSAFSYNFDYWGQGTMVTVSS

SEQ ID NO: 3045 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVFLTMTNMDPVDTATYYCARIVSSLTEYNFDYWGQGTMVTVSS

SEQ ID NO: 3046 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRVDSYSFDYWGQGTMVTVSS

SEQ ID NO: 3047 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTWTSYDFDYWGQGTMVTVSS

SEQ ID NO: 3048 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVAWRYDFDYWGQGTMVTVSS

SEQ ID NO: 3049 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPTSYNFDYWGQGTMVTVSS

SEQ ID NO: 3050 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPFTYSFDYWGQGTMVTVSS

SEQ ID NO: 3051 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESDYTKYDFDYWGQGTMVTVSS

SEQ ID NO: 3052 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPTRYDFDYWGQGTMVTVSS

SEQ ID NO: 3053 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWMANIWWDDDKYYNPSLKNRLTISKDTSKNQVVLTMTNMDPVDTATYYCARIESIPTSYSFDYWGQGTMVTVSS

SEQ ID NO: 3054 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESKPTSYSFDYWGQGTMVTVSS

SEQ ID NO: 3055 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDKYYNPSLKNRLTISKDTSKNQVVLTMTNMDPVDTATYYCARIESSWTTYSFDYWGQGTMVTVSS

SEQ ID NO: 3056 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKTRLTISKDTSKNQVVLTMTNMDPVDTATYYCARIESIGTSYSFDYWGQGTMVTVSS

SEQ ID NO: 3057 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTFKNQVVLTMTNMDPVDTATYYCARIESIPTSYSFDYWGQGTMVTVSS

SEQ ID NO: 3058 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDETYYNPSLKNRLTISKDTSKNQVVLTMTNMDPVDTATYYCARIESDFTSYMFDYWGQGTMVTVSS

SEQ ID NO: 3059 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNWWSYSFDYWGQGTMVTVSS

SEQ ID NO: 3060 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSFTTYSFDYWGQGTMVTVSS

SEQ ID NO: 3061 - protein, 122 aa, Artificial Sequence
  Description of Artificial Sequence: Synthetic polypeptide
  MOD_RES (103)..(103): Any amino acid
  MOD_RES (105)..(105): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESXGXSYSFDYWGQGTMVTVSS

SEQ ID NO: 3062 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRLDTYSFDYWGQGTMVTVSS

SEQ ID NO: 3063 - protein, 122 aa, Artificial Sequence
  Description of Artificial Sequence: Synthetic polypeptide
EVTLRESGPALVKPTQTLTLTCTFSGFSLDTYGMGVGWIRQPPGKALEWLANIWWDDDKYYNPSLKNRLTISKDTSKNQVVLTMTNMDPVDTATYYCARIESIGTSYSFDYWGQGTMVTVSS

SEQ ID NO: 3064 - protein, 122 aa, Artificial Sequence
  Description of Artificial Sequence: Synthetic polypeptide
EVTLRESGPALVKPTQTLTLTCTFSGFSLATSGMGVGWIRQPPGKALEWLANIWWDDDKYYNPSLKNRLTISKDTSKNQVVLTMTNMDPVDTATYYCARIESIPWSYSFDYWGQGTMVTVSS

SEQ ID NO: 3065 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGYSYSFDYWGQGTMVTVSS

SEQ ID NO: 3066 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKNRLTISKDTSKNQVVLTMTNMDPVDTATYYCARIESSWTSYSFDYWGQGTMVTVSS

SEQ ID NO: 3067 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSFFSYSFDYWGQGTMVTVSS

SEQ ID NO: 3068 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDEYYNPSLKNRLTISKDTSKNQVVLTMTNMDPVDTATYYCARIESLGTSYSFDYWGQGTMVTVSS

SEQ ID NO: 3069 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPGSYDFDYWGQGTMVTVSS

SEQ ID NO: 3070 - protein, 122 aa, Artificial Sequence
  Description of Artificial Sequence: Synthetic polypeptide
EVTLRESGPALVKPTQTLTLTCTFSGFSLSTYGMGVGWIRQPPGKELEWLANIWWDDDKYYNPSLKNRLTISKDTSKNQVVLTMTNMDPVDTATYYCARIESNPLTYSFDYWGQGTMVTVSS

SEQ ID NO: 3071 - protein, 122 aa, Artificial Sequence
  Description of Artificial Sequence: Synthetic polypeptide
EVTLRESGPALVKPTKTLTLTCTFSGFSLSTYGMGVGWIRQPPGKALEWLANIWWDDDKYYNPSLKNRLTISKDTSKNQVVLTMTNMDPVDTATYYCARIESIGISYSFDYWGQGTMVTVSS

SEQ ID NO: 3072 - protein, 122 aa, Artificial Sequence
  Description of Artificial Sequence: Synthetic polypeptide
EVTLRESGPALVKPTQTLTLTCTFSGFSLATYGMGVGWIRQPPGKALEWLANIWWDDDKYYNPSLKNRLTISKDTSKNQVVLTMTNMDPVDTATYYCARIESLPTSYSFDYWGQGTMVTVSS

SEQ ID NO: 3073 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPFAYSFDYWGQGTMVTVSS

SEQ ID NO: 3074 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWFTYAFDYWGQGTMVTVSS

SEQ ID NO: 3075 - protein, 122 aa, Artificial Sequence
  Description of Artificial Sequence: Synthetic polypeptide
  MOD_RES (104)..(104): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETIXPKYSFDYWGQGTMVTVSS

SEQ ID NO: 3076 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTTYAFDYWGQGTMVTVSS

SEQ ID NO: 3077 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSEWTYSFDYWGQGTMVTVSS

SEQ ID NO: 3078 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSSWTTYEFDYWGQGTMVTVSS

SEQ ID NO: 3079 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETLGSSYSFDYWGQGTMVTVSS

SEQ ID NO: 3080 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKNRLTISKDTSKNQVVLTMTNMDPVDTATYYCARIESSFTSYSFDYWGQGTMVTVSS

SEQ ID NO: 3081 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESGGISYSFDYWGQGTMVTVSS

SEQ ID NO: 3082 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPTTYSFDYWGQGTMVTVSS

SEQ ID NO: 3083 - protein, 122 aa, Artificial Sequence
  Description of Artificial Sequence: Synthetic polypeptide
EVTLRESGPALVKPTQTLTLTCTFSGFSLYTYGMGVGWIRQPPGKALEWLANIWWDDDKYYNPSLKNRLTISKDTSKNQVVLTMTNMDPVDTATYYCARIESVGTSYSFDYWGQGTMVTVSS

SEQ ID NO: 3084 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWYSYNFDYWGQGTMVTVSS

SEQ ID NO: 3085 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWRSYCFDYWGQGTMVTVSS

SEQ ID NO: 3086 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSPMSYSFDYWGQGTMVTVSS

SEQ ID NO: 3087 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPTSYCFDYWGQGTMVTVSS

SEQ ID NO: 3088 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWWTYSFDYWGQGTMVTVSS

SEQ ID NO: 3089 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESRPTSYCFDYWGQGTMVTVSS

SEQ ID NO: 3090 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVPTSYSFDYWGQGTMVTVSS

SEQ ID NO: 3091 - protein, 122 aa, Artificial Sequence
  Description of Artificial Sequence: Synthetic polypeptide
EVTLRESGPALVKPTQTLTLTCTFSGFSLSTSGMGVGWIRQPPGKALEWLANIWWDDDKYYNPSLKNRLTISKDTSKNQVVLTMTNMDPVDTATYYCARIQSDGPMYSFDYWGQGTMVTVSS

SEQ ID NO: 3092 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESTGASYSFDYWGQGTMVTVSS

SEQ ID NO: 3093 - protein, 122 aa, Artificial Sequence
  Description of Artificial Sequence: Synthetic polypeptide
EVTLRESGPALVKPTQTLTLTCTFSGFSLYTYGMGVGWIRQPPGKALEWLANIWWDDDKYYNPSLKNRLTISKDTSKNQVVLTMTNMDPVDTATYYCARIESLPTSYSFDYWGQGTMVTVSS

SEQ ID NO: 3094 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDTVDTATYYCARIESTPWSYSFDYWGQGTMVTVSS

SEQ ID NO: 3095 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYAFDYWGQGTMVTVSS

SEQ ID NO: 3096 - protein, 122 aa, Artificial Sequence
  Description of Artificial Sequence: Synthetic polypeptide
EVTLRESGPALVKPTQTLTLTCTFSGFSLSTYGMGVGWIRQPPGKELEWLANIWWDDDKYYNPSLNNRLTISKDTSKNQVVLTMTNMDPVDTATYYCARIESSGPKYSFDYWGQGTMVTVSS

SEQ ID NO: 3097 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGWSYSFDYWGQGTMVTVSS

SEQ ID NO: 3098 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSAWTYSFDYWGQGTMVTVSS

SEQ ID NO: 3099 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESYGPKYSFDYWGQGTMVTVSS

SEQ ID NO: 3100 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKTRLTISKDTSKNQVVLTMTNMDPVDTATYYCARIETSWWKYSFDYWGQGTMVTVSS

SEQ ID NO: 3101 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNLSLKNRLTISKDTSKNQVVLTMTNMDPVDTATYYCARIESSPTSYSFDYWGQGTMVTVSS

SEQ ID NO: 3102 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSSYFTYSFDYWGQGTMVTVSS

SEQ ID NO: 3103 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDEEYYNPSLKNRLTISKDTSKNQVVLTMTNMDPVDTATYYCARIESIGISYSFDYWGQGTMVTVSS

SEQ ID NO: 3104 - protein, 122 aa, Artificial Sequence
  Description of Artificial Sequence: Synthetic polypeptide
EVTLRESGPALVKPTQTLTLTCTFSGFSLYTSGMGVGWIRQPPGKALEWLANIWWDDDKYYNPSLKNRLTISKDTSKNQVVLTMTNMDPVDTATYYCARIESSWTTYSFDYWGQGTMVTVSS

SEQ ID NO: 3105 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIPTRYDFDYWGQGTMVTVSS

SEQ ID NO: 3106 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNRVVLTMTNMDPVDTATYYCARIVSDWTTYSFDYWGQGTMVTVSS

SEQ ID NO: 3107 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTDMDPVDTATYYCARIESSWTTYSFDYWGQGTMVTVSS

SEQ ID NO: 3108 - protein, 122 aa, Artificial Sequence
  Description of Artificial Sequence: Synthetic polypeptide
  MOD_RES (2)..(2): Any amino acid
RXHWRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETFGPKYSFDYWGQGTMVTVSS

SEQ ID NO: 3109 - protein, 122 aa, Artificial Sequence
  Description of Artificial Sequence: Synthetic polypeptide
RGNTEESGPALVKPTQTLTLTCTFSGFSLSTYGMGVGWIRQPPGKALEWLANIWWDDDKYYNPSLKNRLTISKDTSKNQVVLTMTNMDPVDTTTYYCARIESLPTSYSFDYWGQGTMVTVSS

SEQ ID NO: 3110 - protein, 122 aa, Artificial Sequence
  Description of Artificial Sequence: Synthetic polypeptide
  MOD_RES (104)..(104): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLXTNYSFDYWGQGTMVTVSS

SEQ ID NO: 3111 - protein, 122 aa, Artificial Sequence
  Description of Artificial Sequence: Synthetic polypeptide
EVTLREGGPALVKPTQTLTLTCTFSGFSLSTYGMGVGWIRQPPGKALEWLANIWWDDDKYYNPSLKNRLTISKDTSKNQVVLTMTNMDPVDTATYYCARIESHWWSYAFDYWGQGTMVTVSS

SEQ ID NO: 3112 - protein, 122 aa, Artificial Sequence
  Description of Artificial Sequence: Synthetic polypeptide
  MOD_RES (121)..(121): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSFTSYSFDYWGQGTMVTEXC

SEQ ID NO: 3113 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESHWWSYAFDYWGQGTMVTVSS

SEQ ID NO: 3114 - protein, 122 aa, Artificial Sequence
  Description of Artificial Sequence: Synthetic polypeptide
  MOD_RES (2)..(2): Any amino acid
  MOD_RES (4)..(4): Any amino acid
RXHXGESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTTYSFDYWGQGTMVTVSS

SEQ ID NO: 3115 - protein, 122 aa, Artificial Sequence
  Description of Artificial Sequence: Synthetic polypeptide
EVTLRESGPALAKPTQTLTLTCTFSGFSLSTYGMGVGWIRQPPGKALEWLANIWWDDDKYYNPSLKNRLTISKDTSKNQVVLTMTNMDPVDTATYYCARIESHWWSYAFDYWGQGTMVTVSS

SEQ ID NO: 3116 - protein, 122 aa, Artificial Sequence
  Description of Artificial Sequence: Synthetic polypeptide
EVTLRESGPALVKPTQTLTLTCAFSGFSLSTYGMGVGWIRQPPGKALEWLANIWWDDDKYYNPSLKNRLTISKDTSKNQVVLTMTNMDPVDTATYYCARIESSWTTYSFDYWGQGTMVTVSS

SEQ ID NO: 3117 - protein, 122 aa, Artificial Sequence
  Description of Artificial Sequence: Synthetic polypeptide
EVTLRESGPALVEPTQTLTLTCTFSGFSLSTYGMGVGWIRQPPGKALEWLANIWWDDDKYYNPSLKNRLTISKDTSKNQVVLTMTNMDPVDTATYYCARIESNPWKYSFDYWGQGTMVTVSS

SEQ ID NO: 3118 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNWRTYSFDYWGQGTMVTVSS

SEQ ID NO: 3119 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSFTSYSFDYWGQGTMVTVSS

SEQ ID NO: 3120 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESHWWSYAFDYWGQGTMVTVSI

SEQ ID NO: 3121 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIVSDWTTYSFDYWGQGTMVTVSS

SEQ ID NO: 3122 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGWSYSFDYWGQGTMVTVSS

SEQ ID NO: 3123 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLPTSYSFDYWGQGTMVTVSS

SEQ ID NO: 3124 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTTYSFDYWGQGTMVTVSS

SEQ ID NO: 3125 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESNPWKYSFDYWGQGTMVTVSS

SEQ ID NO: 3126 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETFGPKYSFDYWGQGTMVTVSS

SEQ ID NO: 3127 - protein, 122 aa, Artificial Sequence
  Description of Artificial Sequence: Synthetic polypeptide
EVTLRESGPALVKPTQTLTLTCTFSGFSLSTYGMGIGWIRQPPGKALEWLANIWWDDDKYYNPSLKNRLTISKDTSKNQVVLTMTNMDPVDTATYYCARIESMGPKYAFDYWGQGTMVTVSS

SEQ ID NO: 3128 - protein, 122 aa, Artificial Sequence
  Description of Artificial Sequence: Synthetic polypeptide
EVTLRESGPALVKPTQTLTLTRTFSGFSLSTYGMGVGWIRQPPGKALEWLANIWWDDDKYYNPSLKNRLTISKDTSKNQVVLTMTNMDPVDTATYYCARIESIPTSYSFDYWGQGTMVTVSS

SEQ ID NO: 3129 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDGDKYYNPSLKNRLTISKDTSKNQVVLTMTNMDPVDTATYYCARIESSGPKYSFDYWGQGTMVTVSS

SEQ ID NO: 3130 - protein, 122 aa, Artificial Sequence
  Description of Artificial Sequence: Synthetic polypeptide
  MOD_RES (111)..(111): Any amino acid
EVTLRESGPALVKPTQTLTLACTFSGFSLSTYGMGVGWIRQPPGKALEWLANIWWDDDKYYNPSLKNRLTISKDTSKNQVVLTMTNMDPVDTATYYCARIESVWTKYYFDXGGQGTMVTVSS

SEQ ID NO: 3131 - protein, 122 aa, Artificial Sequence
  Description of Artificial Sequence: Synthetic polypeptide
  MOD_RES (120)..(120): Any amino acid
EVTLRESGPALVKPTQTLTLTCTFSGFSLSTYEMGVGWIRQPPGKALEWLANIWWDDDKYYNPSLKNRLTISKDTPKNQVVLTMTNMDPVDTATYYCARIESVWTRYDFDYWGQGTMVKXVV

SEQ ID NO: 3132 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESLGTSYSFDYWGQGTMVTVSS

SEQ ID NO: 3133 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGPKYSFDYWGQGTMVTVSS

SEQ ID NO: 3134 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESVWTRYDFDYWGQGTMVTVSS

SEQ ID NO: 3135 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETMGPKYSFDYWGQGTMVTVSS

SEQ ID NO: 3136 - protein, 122 aa, Artificial Sequence
  Description of Artificial Sequence: Synthetic polypeptide
RGNTRESGPALVKPTQTLTLTCTFSGFSLSTYGMGVGWIRQPPGKALKWLANIWWDDDKYYNPSLKNRLTISKDTSKNQVVLTMTNMDPVDTATYYCARIESIGPKYSFDYWGQGTMVTVSS

SEQ ID NO: 3137 - protein, 122 aa, Artificial Sequence
  Description of Artificial Sequence: Synthetic polypeptide
EVTLRESGPAQVKPTQTLTLTCTFSGFSLSTYGMGVGWIRQPPGKALEWLANIWWDDDKYYNPSLKNRLTISKDTSKNQVVLTMTNMDPVDTATYYCARIESIPTSYSFDYWGQGTMVTVSS

SEQ ID NO: 3138 - protein, 122 aa, Artificial Sequence
  Description of Artificial Sequence: Synthetic polypeptide
EVTLRESGPALVKPTQTLTLTCTFSGFSLSTYGMGVGWIRKPPGKALEWLANIWWDDDKYYNPSLKNRLTISKDTSKNQVVLTMTNMDPVDTATYYCARIESSGPKYSFDYWGQGTMVTVSS

SEQ ID NO: 3139 - protein, 122 aa, Artificial Sequence
  Description of Artificial Sequence: Synthetic polypeptide
  MOD_RES (111)..(111): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGPKYSFDXGGQGTMVTVSS

SEQ ID NO: 3140 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIPTSYSFDYWGQGTMVTVSS

SEQ ID NO: 3141 - protein, 122 aa, Artificial Sequence
  Description of Artificial Sequence: Synthetic polypeptide
EVKLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQTIGTNYSFDYWGQGTMVTVSS

SEQ ID NO: 3142 - protein, 122 aa, Artificial Sequence
  Description of Artificial Sequence: Synthetic polypeptide
EGQLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWGQGTMVTVSS

SEQ ID NO: 3143 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWGQSTMVTVSS

SEQ ID NO: 3144 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWGQGTIVTVSS

SEQ ID NO: 3145 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKSRLTISKDTSKNQVVLTMTNMDPVDTATYYCARIESSWTSYSFDYWGQGTMVTVSS

SEQ ID NO: 3146 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTAAYYCARIETIGPKYSFDYWGQGTMVTVSS

SEQ ID NO: 3147 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSGWTNYEFDYWGQGTMVTVVV

SEQ ID NO: 3148 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSMWTRYDFDYWGQGTMVTVSS

SEQ ID NO: 3149 - protein, 122 aa, Artificial Sequence
  Description of Artificial Sequence: Synthetic polypeptide
  MOD_RES (2)..(2): Any amino acid
  MOD_RES (4)..(4): Any amino acid
RXHXRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSGPKYSFDYWGQGTMVTVSS

SEQ ID NO: 3150 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDAATYYCARIQSGWTNYEFDYWGQGTMVTVSS

SEQ ID NO: 3151 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWSQGTMVTVSS

SEQ ID NO: 3152 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIETIGPKYSFDYWGQGTMVTVSS

SEQ ID NO: 3153 - protein, 122 aa, Artificial Sequence; identical to SEQ ID NO: 15
  Description of Artificial Sequence: Synthetic polypeptide

SEQ ID NO: 3154 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWGQGTMVTVSS

SEQ ID NO: 3155 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQAVLTMTNMDPVDTATYYCARIQSGWTNYEFDYWGQGTMVTVSS

SEQ ID NO: 3156 - protein, 122 aa, Artificial Sequence
  Description of Artificial Sequence: Synthetic polypeptide
RGNTEKSGPALVKPTQTLTLTCTFSGFSLSTYGMGVGWIRQPPGKALEWLANIWWDDDKYYNPSLKNRLTISKDTSKNQVVLTMTNMDPVDTATYYCARIESSWTSYSFDYWGQGTMVTVSS

SEQ ID NO: 3157 - protein, 122 aa, Artificial Sequence
  Description of Artificial Sequence: Synthetic polypeptide
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIQSGWTNYEFDYWGQGTMVTVSS

SEQ ID NO: 3158 - protein, 122 aa, Artificial Sequence
  Description of Artificial Sequence: Synthetic polypeptide
  MOD_RES (119)..(119): Any amino acid
EVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMEXVVR

SEQ ID NO: 3159 - protein, 122 aa, Artificial Sequence
  Description of Artificial Sequence: Synthetic polypeptide
EVTLRESGPALVKPTQTLTLTCTFSGFILSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 3160 - protein, 122 aa, Artificial Sequence
  Description of Artificial Sequence: Synthetic polypeptide
EVTLRESGPALVKSTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 3161 - protein, 122 aa, Artificial Sequence; identical to SEQ ID NO: 1
  Description of Artificial Sequence: Synthetic polypeptide

SEQ ID NO: 3162 - protein, 110 aa, Artificial Sequence
  Description of Artificial Sequence: Synthetic polypeptide
  MOD_RES (8)..(8): Any amino acid
  MOD_RES (17)..(17): Any amino acid
  MOD_RES (19)..(19): Any amino acid
EIVLTQSXGTLSLSPGXRXTLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3163 - protein, 110 aa, Artificial Sequence
  Description of Artificial Sequence: Synthetic polypeptide
  MOD_RES (5)..(5): Any amino acid
EIVLXQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3164 - protein, 110 aa, Artificial Sequence
  Description of Artificial Sequence: Synthetic polypeptide
EIVLTQSPGTLSLSPGERATLSCERSSGSIWYSYVSWYQQKPGQAPRLVIYADDQRPTGIPDRFSGSGSGTDFTLTISRLEPEDFAVYYCQSYDINKDLTFGGGTKVEIK

SEQ ID NO: 3165 - protein, 110 aa, Artificial Sequence
  Description of Artificial Sequence: Synthetic polypeptide
EIVLTQSPGTLSLSPGERATLSCERSSGSIGYSYVSWYQQKPGQAPRLVIYAADQRASGIPDRFSGSGSGTDFTLTISRLEPEDFAVYYCQQYGIIIDITFGGGTKVEIK

SEQ ID NO: 3166 - protein, 110 aa, Artificial Sequence
  Description of Artificial Sequence: Synthetic polypeptide
EIVLTQSPGTLSLSPGERATLSCERSSGSIEHAYVSWYQQKPGQAPRLLIYGADHRATGIPDRFSGSGSGTDFTLTISRLEPEDFAVYYCQSYDFNNTITFGGGTKVEIK

SEQ ID NO: 3167 - protein, 110 aa, Artificial Sequence
  Description of Artificial Sequence: Synthetic polypeptide
EIVLTQSPGTLSLSPGERATLSCERSSGDIGHCYVSWYQQKPGQAPRLVIYAADHRPSGIPDRFSGSGSGTDFTLTISRLEPEDFAVYYCQQYGKNIDGTFGGGTKVEIK

SEQ ID NO: 3168 - protein, 110 aa, Artificial Sequence
  Description of Artificial Sequence: Synthetic polypeptide
EIVLTQSPGTLSLSPGERATLSCRASSGDIGDFCVSWYQQKPGQAPRLLIYVDDQRATGIPDRFSGSGSGTDFTLTISRLEPEDFAVYYCQSYGRRLDITFGGGTKVEIK

SEQ ID NO: 3169 - protein, 110 aa, Artificial Sequence
  Description of Artificial Sequence: Synthetic polypeptide
EIVLTQSPGTLSLSPGERATLSCERSSGDIVLPYVSWYQQKPGQAPRLVIYAADWRPTGIPDRFSGSGSGTDFTLTISRLEPEDFAVYYCQQYDITIDTVFGGGTKVEIK

SEQ ID NO: 3170 - protein, 110 aa, Artificial Sequence
  Description of Artificial Sequence: Synthetic polypeptide
EIVLTQSPGTLSLSPGERATLSCRASSGSIGYECVSWYQQKPGQAPRLVIYADDQRATGIPDRFSGSGSGTDFTLTISRLEPEDFAVYYCQSYGIDRQIVFGGGTKVEIK

SEQ ID NO: 3171 - protein, 110 aa, Artificial Sequence
  Description of Artificial Sequence: Synthetic polypeptide
EIVLTQSPGTLSLSPGERATLSCRASSGSIVGSYVSWYQQKPGQAPRLVIYADDQRATGIPDRFSGSGSGTDFTLTISRLEPEDFAVYYCQQYGVHIDITFGGGTKVEIK

SEQ ID NO: 3172 - protein, 110 aa, Artificial Sequence
  Description of Artificial Sequence: Synthetic polypeptide
EIVLTQSPGTLSLSPGERATLSCERSSGDIGHSDVSWYQQKPGQAPRLVIYADDQRASGIPDRFSGSGSGTDFTLTISRLEPEDFAVYYCQSYDINIGQVFGGGTKVEIK

SEQ ID NO: 3173 - protein, 110 aa, Artificial Sequence
  Description of Artificial Sequence: Synthetic polypeptide
EIVLTQSPGTLSLSPGERATLSCRASSGSIGHPYVSWYQQKPGQAPRLLIYADDQRASGIPDRFSGSGSGTDFTLTISRLEPEDFAVYYCQSYGCHIYNVFGGGTKVEIK

SEQ ID NO: 3174 - protein, 110 aa, Artificial Sequence
  Description of Artificial Sequence: Synthetic polypeptide
EIVLTQSPGTLSLSPGERATLSCERSSGSICDTYVSWYQQKPGQAPRLVIYADDQRASGIPDRFSGSGSGTDFTLTISRLEPEDFAVYYCQSYDIYIHIVFGGGTKVEIK

SEQ ID NO: 3175 - protein, 110 aa, Artificial Sequence
  Description of Artificial Sequence: Synthetic polypeptide
EIVLTQSPGTLSLSPGERATLSCERSSGDIGYSCVSWYQQKPGQAPRLVIYADDQRATGIPDRFSGSGSGTDFTLTISRLEPEDFAVYYCQQYGIDIVIVFGGGTKVEIK

SEQ ID NO: 3176 - protein, 110 aa, Artificial Sequence
  Description of Artificial Sequence: Synthetic polypeptide
EIVLTQSPGTLSLSPGERATLSCERSSGSIGYSDVSWYQQKPGQAPRLLIYADDKRATGIPDRFSGSGSGTDFTLTISRLEPEDFAVYYCQSYGIDKYIVFGGGTKVEIK

SEQ ID NO: 3177 - protein, 110 aa, Artificial Sequence
  Description of Artificial Sequence: Synthetic polypeptide
EIVLTQSPGTLSLSPGERATLSCERSSGDIWHFYVSWYQQKPGQAPRLVIYAADHRPTGIPDRFSGSGSGTDFTLTISRLEPEDFAVYYCQQYGTNIEIVFGGGTKVEIK

SEQ ID NO: 3178 - protein, 110 aa, Artificial Sequence
  Description of Artificial Sequence: Synthetic polypeptide
  MOD_RES (32)..(32): Any amino acid
EIVLTQSPGTLSLSPGERATLSCERSSGDIGXADVSWYQQKPGQAPRLVIYVDDQRPSGIPDRFSGSGSGTDFTLTISRLEPEDFAVYYCQSYGEYIDRTFGGGTKVEIK

SEQ ID NO: 3179 - protein, 110 aa, Artificial Sequence
  Description of Artificial Sequence: Synthetic polypeptide
EIVLTQSPGTLSLSPGERATLSCRASSGSIGGSYVSWYQQKPGQAPRLLIYADDHRATGIPDRFSGSGSGTDFTLTISRLEPEDFAVYYCQQYGINIGTVFGGGTKVEIK

SEQ ID NO: 3180 - protein, 110 aa, Artificial Sequence
  Description of Artificial Sequence: Synthetic polypeptide
EIVLTQSPGTLSLSPGERATLSCERSSGDIECDFVSWYQQKPGQAPRLVIYADDHRASGIPDRFSGSGSGTDFTLTISRLEPEDFAVYYCQQYGINNDITFGGGTKVEIK

SEQ ID NO: 3181 - protein, 110 aa, Artificial Sequence
  Description of Artificial Sequence: Synthetic polypeptide
EIVLTQSPGTLSLSPGERATLSCERSSGDIGCSYVSWYQQKPGQAPRLVIYGDDQRPTGIPDRFSGSGSGTDFTLTISRLEPEDFAVYYCQSYGINKEITFGGGTKVEIK

SEQ ID NO: 3182 - protein, 110 aa, Artificial Sequence
  Description of Artificial Sequence: Synthetic polypeptide
EIVLTQSPGTLSLSPGERATLSCERSSGSIGHSRVSWYQQKPGQAPRLVIYVDDQRASGIPDRFSGSGSGTDFTLTISRLEPEDFAVYYCQSYDNNIATVFGGGTKVEIK

SEQ ID NO: 3183 - protein, 110 aa, Artificial Sequence
  Description of Artificial Sequence: Synthetic polypeptide
  MOD_RES (55)..(55): Any amino acid
EIVLTQSPGTLSLSPGERATLSCERSSGSINHCHVSWYQQKPGQAPRLVIYAADXRASGIPDRFSGSGSGTDFTLTISRLEPEDFAVYYCQSYGIILDITFGGGTKVEIK

SEQ ID NO: 3184 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDHRPTGIPDRFSGSGSGTDFTLTISRLEPEDFAVYYCQQYDFDIDITFGGGTKVEIK

SEQ ID NO: 3185 - protein, 110 aa, Artificial Sequence
  Description of Artificial Sequence: Synthetic polypeptide
EIVLTQSPGTLSLSPGERATLSCRASSGSIRYTYVSWYQQKPGQAPRLVIYAADEPPSGIPDRFSGSGSGTDFTLTISRLEPEDFAVYYCQSYDINRNIVFGGGTKVEIK

SEQ ID NO: 3186 - protein, 110 aa, Artificial Sequence
  Description of Artificial Sequence: Synthetic polypeptide
EIVLTQSPGTLSLSPGERATLSCERSSGDIGCTYVSWYQQKPGQAPRLVIYADDQRASGIPDRFSGSGSGTDFTLTISRLEPEDFAVYYCQSYGISTVLVFGGGTKVEIK

SEQ ID NO: 3187 - protein, 110 aa, Artificial Sequence
  Description of Artificial Sequence: Synthetic polypeptide
EIVLTQSPGTLSLSPGERATLSCERSSGDIRYCYVSWYQQKPGQAPRLLIYADDQRASGIPDRFSGSGSGTDFTLTISRLEPEDFAVYYCQSYDIDVDIVFGGGTKVEIK

SEQ ID NO: 3188 - protein, 110 aa, Artificial Sequence
  Description of Artificial Sequence: Synthetic polypeptide
EIVLTQSPGTLSLSPGERATLSCRASSGSISQSYVSWYQQKPGQAPRLVIYADDLRATGIPDRFSGSGSGTDFTLTISRLEPEDFAVYYCQQYGINIDITFGGGTKVEIK

SEQ ID NO: 3189 - protein, 110 aa, Artificial Sequence
  Description of Artificial Sequence: Synthetic polypeptide
EIVLTQSPGTLSLSPGERATLSCERSSGSIFYGCVSWYQQKPGQAPRLLIYADDQRPTGIPDRFSGSGSGTDFTLTISRLEPEDFAVYYCQQYDINIVITFGGGTKVEIK

SEQ ID NO: 3190 - protein, 110 aa, Artificial Sequence
  Description of Artificial Sequence: Synthetic polypeptide
EIVLTQSPGTLSLSPGERATLSCRASSGSIWYSYVSWYQQKPGQAPRLVIYAADQRATGIPDRFSGSGSGTDFTLTISRLEPEDFAVYYCQSYDINKYAVFGGGTKVEIK

SEQ ID NO: 3191 - protein, 110 aa, Artificial Sequence
  Description of Artificial Sequence: Synthetic polypeptide
EIVLTQSPGTLSLSPGERATLSCRASSGDISYSYVSWYQQKPGQAPRLVIYVDDERASGIPDRFSGSGSGTDFTLTISRLEPEDFAVYYCQQYDIYKDLTFGGGTKVEIK

SEQ ID NO: 3192 - protein, 110 aa, Artificial Sequence
  Description of Artificial Sequence: Synthetic polypeptide
  MOD_RES (55)..(55): Any amino acid
EIVLTQSPGTLSLSPGERATLSCERSSGDIGDSYVSWYQQKPGQAPRLVIYADDXRPTGIPDRFSGSGSGTDFTLTISRLEPEDFAVYYCQQYDSNIDIVFGGGTKVEIK

SEQ ID NO: 3193 - protein, 110 aa, Artificial Sequence
  Description of Artificial Sequence: Synthetic polypeptide
  MOD_RES (33)..(33): Any amino acid
EIVLTQSPGTLSLSPGERATLSCERSSGSICYXYVSWYQQKPGQAPRLLIYADDQRASGIPDRFSGSGSGTDFTLTISRLEPEDFAVYYCQQYDVNLEHTFGGGTKVEIK

SEQ ID NO: 3194 - protein, 110 aa, Artificial Sequence
  Description of Artificial Sequence: Synthetic polypeptide
EIVLTQSPGTLSLSPGERATLSCRASSGDIRHCYVSWYQQKPGQAPRLLIYPDDLRPSGIPDRFSGSGSGTDFTLTISRLEPEDFAVYYCQSYDINIDIVFGGGTKVEIK

SEQ ID NO: 3195 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYVDDHRATGIPDRFSGSGSGTDFTLTISRLEPEDFAVYYCQQYGTSLDNTFGGGTKVEIK

SEQ ID NO: 3196 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYAADHRPTGIPDRFSGSGSGTDFTLTISRLEPEDFAVYYCQQYGVNIYITFGGGTKVEIK

SEQ ID NO: 3197 - protein, 110 aa, Artificial Sequence
  Description of Artificial Sequence: Synthetic polypeptide
EIVLTQSPGTLSLSPGERATLSCRASSGSIRYSYVSWYQQKPGQAPRLVIYADDQRATGIPDRFSGSGSGTDFTLTISRLEPEDFAVYYCQQYDINKVIVFGGGTKVEIK

SEQ ID NO: 3198 - protein, 110 aa, Artificial Sequence
  Description of Artificial Sequence: Synthetic polypeptide
EIVLTQSPGTLSLSPGERATLSCERSSGDIGKPTSPWYQQKPGQAPRLVIYSADERPSGIPDRFSGSGSGTDFTLTISRLEPEDFAVYYCQQYGVNRDIVFGGGTKVEIK

SEQ ID NO: 3199 - protein, 110 aa, Artificial Sequence
  Description of Artificial Sequence: Synthetic polypeptide
EIVLTQSPGTLSLSPGERATLSCERSSGSIGPCYVSWYQQKPGQAPRLVIYADDHRASGIPDRFSGSGSGTDFTLTISRLEPEDFAVYYCQQYDINLVITFGGGTKVEIK

SEQ ID NO: 3200 - protein, 110 aa, Artificial Sequence
  Description of Artificial Sequence: Synthetic polypeptide
EIVLTQSPGTLSLSPGERATLSCERSSGSIHYSYVSWYQQKPGQAPRLVIYADDQRPSGIPDRFSGSGSGTDFTLTISRLEPEDFAVYYCQSYGISIDITFGGGTKVEIK

SEQ ID NO: 3201 - protein, 110 aa, Artificial Sequence
  Description of Artificial Sequence: Synthetic polypeptide
EIVLTQSPGTLSLSPGERATLSCERSSGDIGDPYVSWYQQKPGQAPRLVIYAADPRASGIPDRFSGSGSGTDFTLTISRLEPEDFAVYYCQQYDISIYIVFGGGTKVEIK

SEQ ID NO: 3202 - protein, 110 aa, Artificial Sequence
  Description of Artificial Sequence: Synthetic polypeptide
EIVLTQSPGTLSLSPGERATLSCERSSGDIKHCCVSWYQQKPGQAPRLVIYLDDQRPSGIPDRFSGSGSGTDFTLTISRLEPEDFAVYYCQQYDISIDITFGGGTKVEIK

SEQ ID NO: 3203 - protein, 110 aa, Artificial Sequence
  Description of Artificial Sequence: Synthetic polypeptide
EIVLTQSPGTLSLSPGERATLSCRASSGSIVQSYVSWYQQKPGQAPRLLIYSDDPRASGIPDRFSGSGSGTDFTLTISRLEPEDFAVYYCQSYGLYRDITFGGGTKVEIK

SEQ ID NO: 3204 - protein, 110 aa, Artificial Sequence
  Description of Artificial Sequence: Synthetic polypeptide
  MOD_RES (55)..(55): Any amino acid
EIVLTQSPGTLSLSPGERATLSCRASSGSISYSYVSWYQQKPGQAPRLLIYADDXRASGIPDRFSGSGSGTDFTLTISRLEPEDFAVYYCQHYDIHINITFGGGTKVEIK

SEQ ID NO: 3205 - protein, 110 aa, Artificial Sequence
  Description of Artificial Sequence: Synthetic polypeptide
EIVLTQSPGTLSLSPGERATLSCRASSGDIGYAHVSWYQQKPGQAPRLLIYGDDQRASGIPDRFSGSGSGTDFTLTISRLEPEDFAVYYCQSYGKNSEITFGGGTKVEIK

SEQ ID NO: 3206 - protein, 110 aa, Artificial Sequence
  Description of Artificial Sequence: Synthetic polypeptide
EIVLTQSPGTLSLSPGERATLSCRASSGSIGHSYVSWYQQKPGQAPRLLIYDDDPRPSGIPDRFSGSGSGTDFTLTISRLEPEDFAVYYCQQYGINVDIVFGGGTKVEIK

SEQ ID NO: 3207 - protein, 110 aa, Artificial Sequence
  Description of Artificial Sequence: Synthetic polypeptide
EIVLTQSPGTLSLSPGERATLSCRASSGSIGHSCVSWYQQKPGQAPRLVIYSADERASGIPDRFSGSGSGTDFTLTISRLEPEDFAVYYCQQYDLNTLFVFGGGTKVEIK

SEQ ID NO: 3208 - protein, 110 aa, Artificial Sequence
  Description of Artificial Sequence: Synthetic polypeptide
  MOD_RES (33)..(33): Any amino acid
EIVLTQSPGTLSLSPGERATLSCRASSGDIGHXYVSWYQQKPGQAPRLVIYAADHRPSGIPDRFSGSGSGTDFTLTISRLEPEDFAVYYCQQYGISIAVVFGGGTKVEIK

SEQ ID NO: 3209 - protein, 110 aa, Artificial Sequence
  Description of Artificial Sequence: Synthetic polypeptide
EIVLTQSPGTLSLSPGERATLSCERSSGSIGLSYVSWYQQKPGQAPRLVIYAADQRPSGIPDRFSGSGSGTDFTLTISRLEPEDFAVYYCQQYDRHLDATFGGGTKVEIK

SEQ ID NO: 3210 - protein, 110 aa, Artificial Sequence
  Description of Artificial Sequence: Synthetic polypeptide
EIVLTQSPGTLSLSPGERATLSCERSSGDIGCSYVSWYQQKPGQAPRLLIYGADHRASGIPDRFSGSGSGTDFTLTISRLEPEDFAVYYCQQYGIDIDITFGGGTKVEIK

SEQ ID NO: 3211 - protein, 110 aa, Artificial Sequence
  Description of Artificial Sequence: Synthetic polypeptide
EIVLTQSPGTLSLSPGERATLSCERSSGDIGDASVSWYQQKPGQAPRLLIYAADQRASGIPDRFSGSGSGTDFTLTISRLEPEDFAVYYCQSYDITIGVVFGGGTKVEIK

SEQ ID NO: 3212 - protein, 110 aa, Artificial Sequence
  Description of Artificial Sequence: Synthetic polypeptide
EIVLTQSPGTLSLSPGERATLSCERSSGDIGYCFVSWYQQKPGQAPRLVIYAADLRASGIPDRFSGSGSGTDFTLTISRLEPEDFAVYYCQSYGIKIGITFGGGTKVEIK

SEQ ID NO: 3213 - protein, 110 aa, Artificial Sequence
  Description of Artificial Sequence: Synthetic polypeptide
EIVLTQSPGTLSLSPGERATLSCERSSGDIGYWDVSWYQQKPGQAPRLLIYADDERASGIPDRFSGSGSGTDFTLTISRLEPEDFSVYYCQSYGINKDFVFGGGTKVEIK

SEQ ID NO: 3214 - protein, 110 aa, Artificial Sequence
  Description of Artificial Sequence: Synthetic polypeptide
EIVLTQSPGTLSLSPGERATLSCRASSGDIGHTYVSWYQQKPGQAPRLVIYTDDLRASGIPDRFSGSGSGTDFTLTISRLDPEDFAVYYCQQYDLNIDIVFGGGTKVEIK

SEQ ID NO: 3215 - protein, 110 aa, Artificial Sequence
  Description of Artificial Sequence: Synthetic polypeptide
  MOD_RES (32)..(32): Any amino acid
  MOD_RES (99)..(99): Any amino acid
EIVLTQSPGTLSLSPGERATLSCERSSGSIGXSHVSWYQQKPGQAPRLLIYVDDQRPSGIPDRFSGSGSGTDFTLTISRLEPEDFAVYYCQSYGIKKGXTFGGGTKVEIK

SEQ ID NO: 3216 - protein, 110 aa, Artificial Sequence
  Description of Artificial Sequence: Synthetic polypeptide
EIVLTQSPGTLSLSPGERATLSCRASSGDIGHSFVSWYQQKPGQAPRLVIYADDHRASGIPDRFSGSGSGTDFTLTISRLEPEDFAVYYCQSYGVNIDITFGGGTKVEIK

SEQ ID NO: 3217 - protein, 110 aa, Artificial Sequence
  Description of Artificial Sequence: Synthetic polypeptide
EIVLTQSPGTLSLSPGERATLSCRASSGSIFQSDVSWYQQKPGQAPRLVIYADDHRPSGIPDRFSGSGSGTDFTLTISRLEPEDFAVYYCQQYGKNIYIVFGGGTKVEIK

SEQ ID NO: 3218 - protein, 110 aa, Artificial Sequence
  Description of Artificial Sequence: Synthetic polypeptide
  MOD_RES (50)..(50): Any amino acid
EIVLTQSPGTLSLSPGERATLSCRASSGDIGYSAVSWYQQKPGQAPRLVXYVDDQRATGIPDRFSGSGSGTDFTLTISRLEPEDFAVYYCQSYGIKLDFVFGGGTKVEIK

SEQ ID NO: 3219 - protein, 110 aa, Artificial Sequence
  Description of Artificial Sequence: Synthetic polypeptide
  MOD_RES (53)..(53): Any amino acid
EIVLTQSPGTLSLSPGERATLSCRASSGSIVYSSVSWYQQKPGQAPRLVIYVXDQRASGIPDRFSGSGSGTDFTLTISRLEPEDFAVYYCQQYDIHIDITFGGGTKVEIK

SEQ ID NO: 3220 - protein, 110 aa, Artificial Sequence
  Description of Artificial Sequence: Synthetic polypeptide
EIVLTQSPGTLSLSPGERATLSCRASSGSIRDFYVSWYQQKPGQAPRLVIYADDQRASGIPDRFSGSGSGTDFTLTISRLEPEDFAVYYCQQYGINLDNTFGGGTKVEIK

SEQ ID NO: 3221 - protein, 110 aa, Artificial Sequence
  Description of Artificial Sequence: Synthetic polypeptide
EIVLTQSPGTLSLSPGERATLSCERSSGDISDSHVSWYQQKPGQAPRLVIYADDQRPSGIPDRFSGSGSGTDFTLTISRLEPEDFAVYYCQSYDINIDITFGGGTKVEIK

SEQ ID NO: 3222 - protein, 110 aa, Artificial Sequence
  Description of Artificial Sequence: Synthetic polypeptide
EIVLTQSPGTLSLSPGERATLSCERSSGSIALSYVSWYQQKPGQAPRLVIYADDQRPSGIPDRFSGSGSGTDFTLTISRLEPEDFAVYYCQSYGINLDIVFGGGTKVEIK

SEQ ID NO: 3223 - protein, 110 aa, Artificial Sequence
  Description of Artificial Sequence: Synthetic polypeptide
EIVLTQSPGTLSLSPGERATLSCERSSGDMRYSDVSWYQQKPGQAPRMVIYAVDQRASGIPDRLSGSGSGTDFTLTISRLEPEDFAVYYCQQYDVGMVLTFGGGTKVEIK

SEQ ID NO: 3224 - protein, 110 aa, Artificial Sequence
  Description of Artificial Sequence: Synthetic polypeptide
EIVLTQSPGTLSLSPGERATLSCRASSGDIGHFYVSWYQQKPGQAPRLLIYADDQRASGIPDRFSGSGSGTDFTLTISRLEPEDFAVYYCQSYGISIDLTFGGGTKVEIK

SEQ ID NO: 3225 - protein, 110 aa, Artificial Sequence
  Description of Artificial Sequence: Synthetic polypeptide
EIVLTQSPGTLSLSPGERATLSCERSSGDIDHSYVSWYQQKPGQAPRLVIYADDPRATGIPDRFSGSGSGTDFTLTISRLEPEDFAVYYCQSYGLNIDLTFGGGTKVEIK

SEQ ID NO: 3226 - protein, 110 aa, Artificial Sequence
  Description of Artificial Sequence: Synthetic polypeptide
EIVLTQSPGTLSLSPGERATLSCERSSGSIRHSCVSWYQQKPGQAPRLVIYADDHRASGIPDRFSDSGSGTDFTLTISRLEPEDFAVYYCQSYDINIDIVFGGGTKVEIK

SEQ ID NO: 3227 - protein, 110 aa, Artificial Sequence
  Description of Artificial Sequence: Synthetic polypeptide
EIVLTQSPGTLSLSPGERATLSCRASSGDIWHSYVSWYQQKPGQAPRLVIYTDDHRASGIPDRFSGSGSGTDFTLTISRLEPEDFAVYYCQQYGCDKDITFGGGTKVEIK

SEQ ID NO: 3228 - protein, 110 aa, Artificial Sequence
  Description of Artificial Sequence: Synthetic polypeptide
EIVLTQSPGTLSLSPGERATLSCRASSGSIGDFYVSWYQQKPGQAPRLVIYADDQRPTGIPDRLSGSGSGTDFTLTISRLEPEDFAVYYCQQYGIHIEIVFGGGTKVEIK

SEQ ID NO: 3229 - protein, 110 aa, Artificial Sequence
  Description of Artificial Sequence: Synthetic polypeptide
EIVLTQSPGTLSLSPGERATLSCRASSGDIGHSAVSWYQQKPGQAPRLLIYADDPRATGIPDRFSGSGSGTDFTLTISRLEPEDFAVYYCQQYGKNKELVFGGGTKVEIK

SEQ ID NO: 3230 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQQYGINSYLVFGGGTKVEIK

SEQ ID NO: 3231 - protein, 110 aa, Artificial Sequence
  Description of Artificial Sequence: Synthetic polypeptide
EIVLTQSPGTLSLSPGERATLSCRASSGDIGPSYVSWYQQKPGQAPRLLIYPDDQRATGIPDRFSGSGSGTDFTLTISRLEPEDFAVYYCQQYDINKELVFGGGTKVEIK

SEQ ID NO: 3232 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYADDQRATGIPDRFSGSGSGTDFTLTISRLEPEDFAVYYCQQYGKNVDIVFGGGTKVEIK

SEQ ID NO: 3233 - protein, 110 aa, Artificial Sequence
  Description of Artificial Sequence: Synthetic polypeptide
EIVLTQSPGTLSLSPGERATLSCRASSGSILDTYVSWYQQKPGQAPRLVIYADDSRATGIPDRFSGSGSGTDFTLTISRLEPEDFAVYYCQQYDVNVDIVFGGGTKVEIK

SEQ ID NO: 3234 - protein, 110 aa, Artificial Sequence
  Description of Artificial Sequence: Synthetic polypeptide
  MOD_RES (95)..(95): Any amino acid
EIVLTQSPGTLSLSPGERATLSCRASSGSISQSYVSWYQQKPGQAPRLVIYADDQRASGIPDRFSGSGSGTDFTLTISRLEPEDFAVYYCQSYDXTIGIVFGGGTKVEIK

SEQ ID NO: 3235 - protein, 110 aa, Artificial Sequence
  Description of Artificial Sequence: Synthetic polypeptide
EIVLTQSPGTLSLSPGERATLSCERSSGSIGFSYVSWYQQKPGQAPRLVIYEDDPRPSGIPDRFSGSGSGTDFTLTISRLEPEDFAVYYCQQYGANIEIVFGGGTKVEIK

SEQ ID NO: 3236 - protein, 110 aa, Artificial Sequence
  Description of Artificial Sequence: Synthetic polypeptide
EIVLTQSPGTLSLSPGERATLSCRASSGYISHEYVSWYQQKPGQAPRLVIYAADQRPSGIPDRFSGSGSGTDFTLTISRLEPEDFAVYYCQQYGIHIHVTFGGGTKVEIK

SEQ ID NO: 3237 - protein, 110 aa, Artificial Sequence
  Description of Artificial Sequence: Synthetic polypeptide
EIVLTQSPGTLSLSPGERATLSCRASSGDIGHSYVSWYQQKPGQAPRLVIYEDDQRPTGIPDRFSGSGSGTDFTLTISRLEPEDFAVYYCQSYGGNIGIVFGGGTKVEIK

SEQ ID NO: 3238 - protein, 110 aa, Artificial Sequence
  Description of Artificial Sequence: Synthetic polypeptide
EIVLTQSPGTLSLSPGERATLSCRASSGSIDASYVSWYQQKPGQAPRLLIYTDDRRASGIPDRFSGSGSGTDFTLTISRLEPEDFAVYYCQQYGIILDIVFGGGTKVEIK

SEQ ID NO: 3239 - protein, 110 aa, Artificial Sequence
  Description of Artificial Sequence: Synthetic polypeptide
EIVLTQSPGTLSLSPGERATLSCRASSGSIGYSYVSWYQQKPGQAPRLLIYADDHRPSGIPDRFSGSGSGTDFTLTISRLEPEDFAVYYCQQYGVIIYITFGGGTKVEIK

SEQ ID NO: 3240 - protein, 110 aa, Artificial Sequence
  Description of Artificial Sequence: Synthetic polypeptide
  MOD_RES (55)..(55): Any amino acid
EIVLTQSPGTLSLSPGERATLSCRASSGDIFYSYVSWYQQKPGQAPRLVIYADDXRASGIPDRFSGSGSGTDFTLTISRLEPEDFAVYYCQSYDINIDIVFGGGTKVEIK

SEQ ID NO: 3241 - protein, 110 aa, Artificial Sequence
  Description of Artificial Sequence: Synthetic polypeptide
  MOD_RES (47)..(47): Any amino acid
  MOD_RES (55)..(55): Any amino acid
  MOD_RES (71)..(71): Any amino acid
  MOD_RES (85)..(85): Any amino acid
EIVLTQSPGTLSLSPGERATLSCERSSGDIGYLYVSWYQQKPGQAPXLVIYPDDXRASGIPDRFSGSGSGXDFTLTISRLEPEDXAVYYCQQYDKTIDIVFGGGTKVEIK

SEQ ID NO: 3242 - protein, 110 aa, Artificial Sequence
  Description of Artificial Sequence: Synthetic polypeptide
EIVLTQSPGTLSLSPGERATLSCRASSGDICESCVSWYQQKPGQAPRLVIYADDQRASGIPDRFSGSGSGTDFTLTISRLEPEDFAVYYCQSYGINKDIVFGGGTKVEIK

SEQ ID NO: 3243 - protein, 110 aa, Artificial Sequence
  Description of Artificial Sequence: Synthetic polypeptide
  MOD_RES (95)..(95): Any amino acid
EIVLTQSPGTLSLSPGERATLSCERSSGDIGYSNVSWYQQKPGQAPRLLIYEDDKRASGIPDRFSGSGSGTDFTLTISRLEPEDFAVYYCQQYGXLVPIVFGGGTKVEIK

SEQ ID NO: 3244 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYADDQRATGIPDRFSGSGSGTDFTLTISRLEPEDFAVYYCQQYGIKVDSTFGGGTKVEIK

SEQ ID NO: 3245 - protein, 110 aa, Artificial Sequence
  Description of Artificial Sequence: Synthetic polypeptide
  MOD_RES (55)..(55): Any amino acid
EIVLTQSPGTLSLSPGERATLSCERSSGSIQSLHVSWYQQKPGQAPRLLIYADDXRASGIPDRFSGSGSGTDFTLTISRLEPEDFAVYYCQSYGRHIGLVFGGGTKVEIK

SEQ ID NO: 3246 - protein, 110 aa, Artificial Sequence
  Description of Artificial Sequence: Synthetic polypeptide
EIVLTQSPGTLSLSPGERATLSCERSSGSIGYCYVSWYQQKPGQAPRLVIYADDHRASGIPDRFSGSGSGTDFTLTISRLEPEDFAVYYCQQYDLCIYITFGGGTKVEIK

SEQ ID NO: 3247 - protein, 110 aa, Artificial Sequence
  Description of Artificial Sequence: Synthetic polypeptide
EIVLTQSPGTLSLSPGERATLSCERSSGDIGDSHVSWYQQKPGQAPRLVIYADDQRASGIPDRFSGSGSGTDFTLTISRLEPEDFAVYYCQSYDINIAITFGGGTKVEIK

SEQ ID NO: 3248 - protein, 110 aa, Artificial Sequence
  Description of Artificial Sequence: Synthetic polypeptide
EIVLTQSPGTLSLSPGERATLSCERSSGDIGYTYVSWYQQKPGQAPRLLIYPDDKRPTGIPDRFSGSGSGTDFTLTISRLEPEDFAVYYCQSYGIIRPTTFGGGTKVEIK

SEQ ID NO: 3249 - protein, 110 aa, Artificial Sequence
  Description of Artificial Sequence: Synthetic polypeptide
EIVLTQSPGTLSLSPGERATLSCERSSGDIAHSYVSWYQQKPGQAPRLVIYAADYRASGIPDRFSGSGSGTDFTLTISRLEPEDFAVYYCQQYDSHNNIVFGGGTKVEIK

SEQ ID NO: 3250 - protein, 110 aa, Artificial Sequence
  Description of Artificial Sequence: Synthetic polypeptide
EIVLTQSPGTLSLSPGERATLSCRASSGSIRGLRVSWYQQKPGQAPRLLIYADDQRASGIPDRFSGSGSGTDFTLTISRLEPEDFAVYYCQSYGLNFDIVFGGGTKVEIK

SEQ ID NO: 3251 - protein, 110 aa, Artificial Sequence
  Description of Artificial Sequence: Synthetic polypeptide
EIVLTQSPGTLSLSPGERATLSCRASSGSITYYYVSWYQQKPGQAPRLLIYADDQRASGIPDRFSGSGSGTDFTLTISRLEPEDFAVYYCQSYDINTDIVFGGGTKVEIK

SEQ ID NO: 3252 - protein, 110 aa, Artificial Sequence; identical to SEQ ID NO: 2
  Description of Artificial Sequence: Synthetic polypeptide

SEQ ID NO: 3253 - protein, 110 aa, Artificial Sequence
  Description of Artificial Sequence: Synthetic polypeptide
  MOD_RES (18)..(18): Any amino acid
EIVLTQSPGTLSLSPGEXATLSCERSSGDIGDSYVSWYQQKPGQAPRLVIYVDDQRPSGIPDRFSGSGSGTDFTLTISRLEPEDFAVYYCQSYDINIDIVFGGGTKVEIK

SEQ ID NO: 3254 - protein, 110 aa, Artificial Sequence
  Description of Artificial Sequence: Synthetic polypeptide
  MOD_RES (19)..(19): Any amino acid
EIVLTQSPGTLSLSPGERXTLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3255 - protein, 110 aa, Artificial Sequence
  Description of Artificial Sequence: Synthetic polypeptide
  MOD_RES (7)..(7): Any amino acid
EIVLTQXPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3256 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYSDDQRPGGIPDRFSGSGSGTDFTLTISRLEPEDFAVYYCQSYDINIDIVFGGGTKVEIK

SEQ ID NO: 3257 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGYGSGTDFTLTISRLEPEDFAVYYCQSYDINIDIVFGGGTKVEIK

SEQ ID NO: 3258 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYVDDWRASGIPDRFSGSGSGTDFTLTISRLEPEDFAVYYCQSYGIDIDVVFGGGTKVEIK

SEQ ID NO: 3259 - protein, 110 aa, Artificial Sequence
  Description of Artificial Sequence: Synthetic polypeptide
EIVLTQSPGTLSLSPGERATLSCERSSGDIDYSYVSWYQQKPGQAPRLVIYADDQRASGIPDRFSGSGSGTDFTLTISRLEPEDFAVYYCQSYDIDIDIVFGGGTKVEIK

SEQ ID NO: 3260 - protein, 110 aa, Artificial Sequence
  Description of Artificial Sequence: Synthetic polypeptide
EIVLTQSPGTLSLSPGERATLSCRASSGSIGYSYVSWYQQKPGQAPRLVIYADDQRASGIPDRFSGSGSGTDFTLTISRLEPEDFAVYYCQSYDINTDVVFGGGTKVEIK

SEQ ID NO: 3261 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYADDQRASGIPDRFSGSGSGTDFTLTISRLEPEDFAVYYCQSYDIYIDVTFGGGTKVEIK

SEQ ID NO: 3262 - protein, 110 aa, Artificial Sequence
  Description of Artificial Sequence: Synthetic polypeptide
EIVLTQSPGTLSLSPGERATLSCERSSGSIGYSYVSWYQQKPGQAPRLVIYSDDQRPSGIPDRFSGSGSGTDFTLTISRLEPEDFAVYYCQSYDIDIDIVFGGGTKVEIK

SEQ ID NO: 3263 - protein, 110 aa, Artificial Sequence
  Description of Artificial Sequence: Synthetic polypeptide
EIVLTQSPGTLSLSPGERATLSCERSSGDIAGYYVSWYQQKPGQAPRLVIYADDQRATGIPDRFSGSGSGTDFTLTISRLEPEDFAVYYCQSYDIIIDITFGGGTKVEIK

SEQ ID NO: 3264 - protein, 110 aa, Artificial Sequence
  Description of Artificial Sequence: Synthetic polypeptide
  MOD_RES (100)..(100): Any amino acid
EIVLTQSPGTLSLSPGERATLSCERSSGDIGESYVSWYQQKPGQAPRLVIYADDLRASGIPDRFSGSGSGTDFTLTISRLEPEDFAVYYCQSYGIVIDIXFGGGTKVEIK

SEQ ID NO: 3265 - protein, 110 aa, Artificial Sequence
  Description of Artificial Sequence: Synthetic polypeptide
EIVLTQSPGTLSLSPGERATLSCRASSGSIVYSYVSWYQQKPGQAPRLVIYSDDQRASGIPDRFSGSGSGTDFTLTISRLEPEDFAVYYCQSYDIYIDITFGGGTKVEIK

SEQ ID NO: 3266 - protein, 110 aa, Artificial Sequence
  Description of Artificial Sequence: Synthetic polypeptide
EIVLTQSPGTLSLSPGERATLSCRASSGDIVYSYVSWYQQKPGQAPRLVIYADDQRASGIPDRFSGSGSGTDFTLTISRLEPEDFAVYYCQSYGIDIDVTFGGGTKVEIK

SEQ ID NO: 3267 - protein, 110 aa, Artificial Sequence
  Description of Artificial Sequence: Synthetic polypeptide
EIVLTQSPGTLSLSPGERATLSCRASSGDIWDAYVSWYQQKPGQAPRLLIYADDHRASGIPDRFSGSGSGTDFTLTISRLEPEDFAVYYCQSYDIIIDITFGGGTKVEIK

SEQ ID NO: 3268 - protein, 110 aa, Artificial Sequence
  Description of Artificial Sequence: Synthetic polypeptide
EIVLTQSPGTLSLSPGERATLSCERSSGDIGYAYVSWYQQKPGQAPRLVIYADDYRPTGIPDRFSGSGSGTDFTLTISRLEPEDFAVYYCQSYDIDVDIVFGGGTKVEIK

SEQ ID NO: 3269 - protein, 110 aa, Artificial Sequence
  Description of Artificial Sequence: Synthetic polypeptide
EIVLTQSPGTLSLSPGERATLSCRASSGDILDSYVSWYQQKPGQAPRLVIYSDDQRASGIPDRFSGSGSGTDFTLTISRLEPEDFAVYYCQSYDTIIDITFGGGTKVEIK

SEQ ID NO: 3270 - protein, 110 aa, Artificial Sequence
  Description of Artificial Sequence: Synthetic polypeptide
EIVLTQSPGTLSLSPGERATLSCERSSGDIDDYYVSWYQQKPGQAPRLLIYADDQRASGIPDRFSGSGSGTDFTLTISRLEPEDFAVYYCQSYDIYIDVTFGGGTKVEIK

SEQ ID NO: 3271 - protein, 110 aa, Artificial Sequence
  Description of Artificial Sequence: Synthetic polypeptide
EIVLTQSPGTLSLSPGERATLSCERSSGDIWDFYVSWYQQKPGQAPRLVIYADDQRPSGIPDRFSGSGSGTDFTLTISRLEPEDFAVYYCQSYDVTIDVTFGGGTKVEIK

SEQ ID NO: 3272 - protein, 110 aa, Artificial Sequence
  Description of Artificial Sequence: Synthetic polypeptide
EIVLTQSPGTLSLSPGERATLSCERSSGDIGLSYVSWYQQKPGQAPRLVIYSDDLRASGIPDRFSGSGSGTDFTLTISRLEPEDFAVYYCQSYDVDIDVTFGGGTKVEIK

SEQ ID NO: 3273 - protein, 110 aa, Artificial Sequence
  Description of Artificial Sequence: Synthetic polypeptide
EIVLTQSPGTLSLSPGERATLSCERSSGDIFYTYVSWYQQKPGQAPRLVIYADDQRATGIPDRFSGSGSGTDFTLTISRLEPEDFAVYYCQSYDLDIDITFGGGTKVEIK

SEQ ID NO: 3274 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYADDQRAIGIPDRFSGSGSGTDFTLTISRLEPEDFAVYYCQSYDIYVDVVFGGGTKVEIK

SEQ ID NO: 3275 - protein, 110 aa, Artificial Sequence
  Description of Artificial Sequence: Synthetic polypeptide
EIVLTQSPGTLSLSPGERATLSCRASSGDIEGSYVSWYQQKPGQAPRLVIYSDDLRASGIPDRFSGSGSGTDFTLTISRLEPEDFAVYYCQSYDIIIDIVFGGGTKVEIK

SEQ ID NO: 3276 - protein, 110 aa, Artificial Sequence
  Description of Artificial Sequence: Synthetic polypeptide
EIVLTQSPGTLSLSPGERATLSCRASSGDISCSYVSWYQQKPGQAPRLVIYADDQRATGIPDRFSGSGSGTDFTLTISRLEPEDFAVYYCQSYDINTDIVFGGGTKVEIK

SEQ ID NO: 3277 - protein, 110 aa, Artificial Sequence
  Description of Artificial Sequence: Synthetic polypeptide
EIVLTQSPGTLSLSPGERATLSCRASSGSIGSYYVSWYQQKPGQAPRLVIYSDDQRPTGIPDRFSGSGSGTDFTLTISRLEPEDFAVYYCQSYDIYIDVVFGGGTKVEIK

SEQ ID NO: 3278 - protein, 110 aa, Artificial Sequence
  Description of Artificial Sequence: Synthetic polypeptide
EIVLTQSPGTLSLSPGERATLSCRASSGDIWYSYVSWYQQKPGQAPRLVIYADDQRASGIPDRFSGSGSGTDFTLTISRLEPEDFAVYYCQSYGIEIDVTFGGGTKVEIK

SEQ ID NO: 3279 - protein, 110 aa, Artificial Sequence
  Description of Artificial Sequence: Synthetic polypeptide
EIVLTQSPGTLSLSPGERATLSCRASSGDIGYSYVSWYQQKPGQAPRLLIYADDQRATGIPDRFSGSGSGTDFTLTISRLEPEDFAVYYCQSYDIISDITFGGGTKVEIK

SEQ ID NO: 3280 - protein, 110 aa, Artificial Sequence
  Description of Artificial Sequence: Synthetic polypeptide
EIVLTQSPGTLSLSPGERATLSCRASSGSIDYAYVSWYQQKPGQAPRLVIYADDQRPTGIPDRFSGSGSGTDFTLTISRLEPEDFAVYYCQSYGITIDVVFGGGTKVEIK

SEQ ID NO: 3281 - protein, 110 aa, Artificial Sequence
  Description of Artificial Sequence: Synthetic polypeptide
EIVLTQSPGTLSLSPGERATLSCRASSGSIYFAYVSWYQQKPGQAPRLVIYSDDQRASGIPDRFSGSGSGTDFTLTISRLEPEDFAVYYCQSYGITIDVVFGGGTKVEIK

SEQ ID NO: 3282 - protein, 110 aa, Artificial Sequence
  Description of Artificial Sequence: Synthetic polypeptide
EIVLTQSPGTLSLSPGERATLSCRASSGSIWYSYVSWYQQKPGQAPRLVIYADDQRATGIPDRFSGSGSGTDFTLTISRLEPEDFAVYYCQSYGINVDIVFGGGTKVEIK

SEQ ID NO: 3283 - protein, 110 aa, Artificial Sequence
  Description of Artificial Sequence: Synthetic polypeptide
EIVLTQSPGTLSLSPGERATLSCRASSGDIAHSYVSWYQQKPGQAPRLVIYTDDARASGIPDRFSGSGSGTDFTLTISRLEPEDFAVYYCQSYDIIVDIVFGGGTKVEIK

SEQ ID NO: 3284 - protein, 110 aa, Artificial Sequence
  Description of Artificial Sequence: Synthetic polypeptide
EIVLTQSPGTLSLSPGERATLSCERSSGDICQYYVSWYQQKPGQAPRLLIYADDQRASGIPDRFSGSGSGTDFTLTISRLEPEDFAVYYCQSYDLNIDVTFGGGTKVEIK

SEQ ID NO: 3285 - protein, 110 aa, Artificial Sequence
  Description of Artificial Sequence: Synthetic polypeptide
EIVLTQSPGTLSLSPGERATLSCERSSGSIGDSYVSWYQQKPGQAPRLLIYNDDDRPSGIPDRFSGSGSGTDFTLTISRLEPEDFAVYYCQSYDLTIDVTFGGGTKVEIK

SEQ ID NO: 3286 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRPTGIPDRFSGSGSGTDFTLTISRLEPEDFAVYYCQSYDIIIDIVFGGGTKVEIK

SEQ ID NO: 3287 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYADDQRPSGIPDRFSGSGSGTDFTLTISRLEPEDFAVYYCQSYDIDVDIVFGGGTKVEIK

SEQ ID NO: 3288 - protein, 110 aa, Artificial Sequence
  Description of Artificial Sequence: Synthetic polypeptide
EIVLTQSPGTLSLSPGERATLSCERSSGSIWDMYVSWYQQKPGQAPRLVIYADDQRPTGIPDRFSGSGSGTDFTLTISRLEPEDFAVYYCQSYDIEIDITFGGGTKVEIK

SEQ ID NO: 3289 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYGDDQRASGIPDRFSGSGSGTDFTLTISRLEPEDFAVYYCQSYDIIIDITFGGGTKVEIK

SEQ ID NO: 3290 - protein, 110 aa, Artificial Sequence
  Description of Artificial Sequence: Synthetic polypeptide
EIVLTQSPGTLSLSPGERATLSCERSSGDIWESYVSWYQQKPGQAPRLVIYADDERATGIPDRFSGSGSGTDFTLTISRLEPEDFAVYYCQSYGINIDIVFGGGTKVEIK

SEQ ID NO: 3291 - protein, 110 aa, Artificial Sequence
  Description of Artificial Sequence: Synthetic polypeptide
EIVLTQSPGTLSLSPGERATLSCRASSGDIAYSYVSWYQQKPGQAPRLVIYADDQRASGIPDRFSGSGSGTDFTLTISRLEPEDFAVYYCQSYDINIDIVFGGGTKVEIK

SEQ ID NO: 3292 - protein, 110 aa, Artificial Sequence
  Description of Artificial Sequence: Synthetic polypeptide
EIVLTQSPGTLSLSPGERATLSCRASSGSIFGAYVSWYQQKPGQAPRLVIYADDQRASGIPDRFSGSGSGTDFTLTISRLEPEDFAVYYCQSYGIITDIVFGGGTKVEIK

SEQ ID NO: 3293 - protein, 110 aa, Artificial Sequence
  Description of Artificial Sequence: Synthetic polypeptide
EIVLTQSPGTLSLSPGERATLSCRASSGSIADSLVSWYQQKPGQAPRLVIYTDDWRASGIPDRFSGSGSGTDFTLTISRLEPEDFAVYYCQSYGINIDVVFGGGTKVEIK

SEQ ID NO: 3294 - protein, 110 aa, Artificial Sequence
  Description of Artificial Sequence: Synthetic polypeptide
EIVLTQSPGTLSLSPGERATLSCERSSGSIGDSYVSWYQQKPGQAPRLLIYTDDQRASGIPDRFSGSGSGTDFTLTISRLEPEDFAVYYCQSYDITIDIVFGGGTKVEIK

SEQ ID NO: 3295 - protein, 110 aa, Artificial Sequence
  Description of Artificial Sequence: Synthetic polypeptide
EIVLTQSPGTLSLSPGERATLSCERSSGDIGDYYVSWYQQKPGQAPRLVIYSDDQRPTGIPDRFSGSGSGTDFTLTISRLEPEDFAVYYCQSYDLDIDITFGGGTKVEIK

SEQ ID NO: 3296 - protein, 110 aa, Artificial Sequence
  Description of Artificial Sequence: Synthetic polypeptide
  MOD_RES (50)..(50): Any amino acid
  MOD_RES (96)..(96): Any amino acid
EIVLTQSPGTLSLSPGERATLSCERSSGSIVHSYVSWYQQKPGQAPRLVXYADDQRATGIPDRFSGSGSGTDFTLTISRLEPEDFAVYYCQSYDIXVDIVFGGGTKVEIK

SEQ ID NO: 3297 - protein, 110 aa, Artificial Sequence
  Description of Artificial Sequence: Synthetic polypeptide
EIVLTQSPGTLSLSPGERATLSCRASSGDIWYSYVSWYQQKPGQAPRLVIYADDQRASGIPDRFSGSGSGTDFTLTISRLEPEDFAVYYCQSYGITVDIVFGGGTKVEIK

SEQ ID NO: 3298 - protein, 110 aa, Artificial Sequence
  Description of Artificial Sequence: Synthetic polypeptide
EIVLTQSPGTLSLSPGERATLSCERSSGDIFYSYVSWYQQKPGQAPRLVIYADDERASGIPDRFSGSGSGTDFTLTISRLEPEDFAVYYCQSYDIEIDIVFGGGTKVEIK

SEQ ID NO: 3299 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRATGIPDRFSGSGSGTDFTLTISRLEPEDFAVYYCQSYDIDVDIVFGGGTKVEIK

SEQ ID NO: 3300 - protein, 110 aa, Artificial Sequence
  Description of Artificial Sequence: Synthetic polypeptide
EIVLTQSPGTLSLSPGERATLSCERSSGDIGLSYVSWYQQKPGQAPRLLIYADDQRASGIPDRFSGSGSGTDFTLTISRLEPEDFAVYYCQSYDLIIDIVFGGGTKVEIK

SEQ ID NO: 3301 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYSDDQRPSGIPDRFSGSGSGTDFTLTISRLEPEDFAVYYCQSYDIDIDIVFGGGTKVEIK

SEQ ID NO: 3302 - protein, 110 aa, Artificial Sequence
  Description of Artificial Sequence: Synthetic polypeptide
EIVLTQSPGTLSLSPGERATLSCRASSGDIGYSYVSWYQQKPGQAPRLVIYADDERASGIPDRFSGSGSGTDFTLTISRLEPEDFAVYYCQSYDIEIDITFGGGTKVEIK

SEQ ID NO: 3303 - protein, 110 aa, Artificial Sequence
  Description of Artificial Sequence: Synthetic polypeptide
EIVLTQSPGTLSLSPGERATLSCRASSGDIGYSYVSWYQQKPGQAPRLLIYFDDYRPTGIPDRFSGSGSGTDFTLTISRLEPEDFAVYYCQSYGIEIDIVFGGGTKVEIK

SEQ ID NO: 3304 - protein, 110 aa, Artificial Sequence
  Description of Artificial Sequence: Synthetic polypeptide
EIVLTQSPGTLSLSPGERATLSCERSSGDIGYYYVSWYQQKPGQAPRLVIYADDERATGIPDRFSGSGSGTDFTLTISRLEPEDFAVYYCQSYDIYIDVVFGGGTKVEIK

SEQ ID NO: 3305 - protein, 110 aa, Artificial Sequence
  Description of Artificial Sequence: Synthetic polypeptide
EIVLTQSPGTLSLSPGERATLSCRASSGDISDSYVSWYQQKPGQAPRLVIYTDDHRPSGIPDRFSGSGSGTDFTLTISRLEPEDFAVYYCQSYGINIDIVFGGGTKVEIK

SEQ ID NO: 3306 - protein, 110 aa, Artificial Sequence
  Description of Artificial Sequence: Synthetic polypeptide
EIVLTQSPGTLSLSPGERATLSCERSSGSIGDSYVSWYQQKPGQAPRLVIYVDDWRASGIPDRFSGSGSGTDFTLTISRLEPEDFAVYYCQSYGIDVDIVFGGGTKVEIK

SEQ ID NO: 3307 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYSDDQRPSGIPDRFSGSGSGTDFTLTISRLEPEDFAVYYCQSYDIIIDIVFGGGTKVEIK

SEQ ID NO: 3308 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYADDQRATGIPDRFSGSGSGTDFTLTISRLEPEDFAVYYCQQYDIIDDIVFGGGTKVEIK

SEQ ID NO: 3309 - protein, 110 aa, Artificial Sequence
  Description of Artificial Sequence: Synthetic polypeptide
EIVLTQSPGTLSLSPGERATLSCRASSGDIGYSYVSWYQQKPGQAPRLLIYADDFRPTGIPDRFSGSGSGTDFTLTISRLEPEDFAVYYCQSYGIITDITFGGGTKVEIK

SEQ ID NO: 3310 - protein, 110 aa, Artificial Sequence
  Description of Artificial Sequence: Synthetic polypeptide
EIVLTQSPGTLSLSPGERATLSCERSSGDIYYSYVSWYQQKPGQAPRLVIYSDDQRATGIPDRFSGSGSGTDFTLTISRLEPEDFAVYYCQSYDINIDVTFGGGTKVEIK

SEQ ID NO: 3311 - protein, 110 aa, Artificial Sequence
  Description of Artificial Sequence: Synthetic polypeptide
EIVLTQSPGTLSLSPGERATLSCERSSGDIGYSYVSWYQQKPGLAPRLLIYADDQRPSGIPDRFSGSGSGTDFTLTISRLEPEDFAVYYCQSYGTYVDIVFGGGTKVEIK

SEQ ID NO: 3312 - protein, 110 aa, Artificial Sequence
  Description of Artificial Sequence: Synthetic polypeptide
  MOD_RES (64)..(64): Any amino acid
  MOD_RES (99)..(99): Any amino acid
EIVLTQSPGTLSLSPGERATLSCERSSGDIGDTYVSWYQQKPGQAPRLVIYADDQRASGIPDRXSGSGSGTDFTLTISRLEPEDFAVYYCQSYGINIDXVFGGGTKVEIK

SEQ ID NO: 3313 - protein, 110 aa, Artificial Sequence
  Description of Artificial Sequence: Synthetic polypeptide
EIVLTQSPGTLSLSPGERATLSCERSSGSIWQYYVSWYQQKPGQAPRLVIYSDDQRPSGIPDRFSGSGSGTDFTLTISRLEPEDFAVYYCQSYDINIDIVFGGGTKVEIK

SEQ ID NO: 3314 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDWRPTGIPDRFSGSGSGTDFTLTISRLEPEDFAVYYCQSYDIYIDIVFGGGTKVEIK

SEQ ID NO: 3315 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYADDQRASGIPDRFSGSGSGTDFTLTISRLEPEDFAVYYCQSYDTIIDIVFGGGTKVEIK

SEQ ID NO: 3316 - protein, 110 aa, Artificial Sequence
  Description of Artificial Sequence: Synthetic polypeptide
EIVLTQSPGTLSLSPGERATLSCERSSGDIGDYYVSWYQQKPGQAPRLLIYADDQRASGIPDRFSGSGSGTDFTLTISRLEPEDFAVYYCQSYDIDIDVVFGGGTKVEIK

SEQ ID NO: 3317 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRASGIPDRFSGSGSGTDFTLTISRLEPEDFAVYYCQSYDTIIDIVFGGGTKVEIK

SEQ ID NO: 3318 - protein, 110 aa, Artificial Sequence
  Description of Artificial Sequence: Synthetic polypeptide
EIVLTQSPGTLSLSPGERATLSCERSSGDIWQYYVSWYQQKPGQAPRLVIYADDQRASGIPDRFSGSGSGTDFTLTISRLEPEDFAVYYCQSYDLNIDITFGGGTKVEIK

SEQ ID NO: 3319 - protein, 110 aa, Artificial Sequence
  Description of Artificial Sequence: Synthetic polypeptide
EIVLTQSPGTLSLSPGERATLSCRASSGDIGESYVSWYQQKPGQAPRLVIYSDDSRASGIPDRFSGSGSGTDFTLTISRLEPEDFAVYYCQSYDIIIDIVFGGGTKVEIK

SEQ ID NO: 3320 - protein, 110 aa, Artificial Sequence
  Description of Artificial Sequence: Synthetic polypeptide
EIVLTQSPGTLSLSPGERATLSCRASSGDIGYSYVSWYQQKPGQAPRLVIYADDLRPTGIPDRFSGSGSGTDFTLTISRLEPEDFAVYYCQSYGIIIDIVFGGGTKVEIK

SEQ ID NO: 3321 - protein, 110 aa, Artificial Sequence
  Description of Artificial Sequence: Synthetic polypeptide
EIVLTQSPGTLSLSPGERATLSCERSSGDIGDYYVSWYQQKPGQAPRLVIYWDDYRPSGIPDRFSGSGSGTDFTLTISRLEPEDFAVYYCQSYDVILDITFGGGTKVEIK

SEQ ID NO: 3322 - protein, 110 aa, Artificial Sequence
  Description of Artificial Sequence: Synthetic polypeptide
EIVLTQSPGTLSLSPGERATLSCERSSGDISYTYVSWYQQKPGQAPRLVIYSDDQRASGIPDRFSGSGSGTDFTLTISRLEPEDFAVYYCQSYGIITDIVFGGGTKVEIK

SEQ ID NO: 3323 - protein, 110 aa, Artificial Sequence
  Description of Artificial Sequence: Synthetic polypeptide
EIVLTQSPGTLSLSPGERATLSCERSSGDIGESYVSWYQQKPGQAPRLVIYTDDWRASGIPDRFSGSGSGTDFTLTISRLEPEDFAVYYCQSYGSNIDVVFGGGTKVEIK

SEQ ID NO: 3324 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRATGIPDRFSGSGSGTDFTLTISRLEPEDFAVYYCQSYGILTDITFGGGTKVEIK

SEQ ID NO: 3325 - protein, 110 aa, Artificial Sequence
  Description of Artificial Sequence: Synthetic polypeptide
EIVLTQSPGTLSLSPGERATLSCRASSGSIAHSYVSWYQQKPGQAPRLVIYSDDQRPSGIPDRFSGSGSGTDFTLTISRLEPEDFAVYYCQSYDIIVDIVFGGGTKVEIK

SEQ ID NO: 3326 - protein, 110 aa, Artificial Sequence
  Description of Artificial Sequence: Synthetic polypeptide
EIVLTQSPGTLSLSPGERATLSCRASSGSIVYSYVSWYQQKPGQAPRLVIYADDQRASGIPDRFSGSGSGTDFTLTISRLEPEDFAVYYCQSYGIITDIVFGGGTKVEIK

SEQ ID NO: 3327 - protein, 110 aa, Artificial Sequence
  Description of Artificial Sequence: Synthetic polypeptide
EIVLTQSPGTLSLSPGERATLSCERSSGDISYSYVSWYQQKPGQAPRLVIYADDQRASGIPDRFSGSGSGTDFTLTISRLEPEDFAVYYCQSYDIDIDITFGGGTKVEIK

SEQ ID NO: 3328 - protein, 110 aa, Artificial Sequence
  Description of Artificial Sequence: Synthetic polypeptide
EIVLTQSPGTLSLSPGERATLSCRASSGSIGDTYVSWYQQKPGQAPRLLIYADDWRPSGIPDRFSGSGSGTDFTLTISRLEPEDFAVYYCQSYDIEIDIVFGGGTKVEIK

SEQ ID NO: 3329 - protein, 110 aa, Artificial Sequence
  Description of Artificial Sequence: Synthetic polypeptide
EIVLTQSPGTLSLSPGERATLSCERSSGDIWDTYVSWYQQKPGQAPRLVIYSDDQRASGIPDRFSGSGSGTDFTLTISRLEPEDFAVYYCQSYGINIDIVFGGGTKVEIK

SEQ ID NO: 3330 - protein, 110 aa, Artificial Sequence
  Description of Artificial Sequence: Synthetic polypeptide
EIVLTQSPGTLSLSPGERATLSCERSSGSIGETYVSWYQQKPGQAPRLVIYADDQRASGIPDRFSGSGSGTDFTLTISRLEPEDFAVYYCQSYGTIIDIVFGGGTKVEIK

SEQ ID NO: 3331 - protein, 110 aa, Artificial Sequence
  Description of Artificial Sequence: Synthetic polypeptide
EIVLTQSPGTLSLSPGERATLSCERSSGDIWDTYVSWYQQKPGQAPRLVIYADDQRATGIPDRFSGSGSGTDFTLTISRLEPEDFAVYYCQSYDIIIDIVFGGGTKVEIK

SEQ ID NO: 3332 - protein, 110 aa, Artificial Sequence
  Description of Artificial Sequence: Synthetic polypeptide
EIVLTQSPGTLSLSPGERATLSCERSSGDIWYSYVSWYQQKPGQAPRLLIYADDQRASGIPDRFSGSGSGTDFTLTISRLEPEDFAVYYCQSYDIIIDIVFGGGTKVEIK

SEQ ID NO: 3333 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYADDYRPSGIPDRFSGSGSGTDFTLTISRLEPEDFAVYYCQSYGIIVDITFGGGTKVEIK

SEQ ID NO: 3334 - protein, 110 aa, Artificial Sequence
  Description of Artificial Sequence: Synthetic polypeptide
EIVLTQSPGTLSLSPGERATLSCERSSGDIGQSYVSWYQQKPGQAPRLVIYSDDQRPSGIPDRFSGSGSGTDFTLTISRLEPEDFAVYYCQSYDIIIDIVFGGGTKVEIK

SEQ ID NO: 3335 - protein, 110 aa, Artificial Sequence
  Description of Artificial Sequence: Synthetic polypeptide
EIVLTQSPGTLSLSPGERATLSCRESSGDILYTYVSWYQQKPGQAPRLVIYSDDQRASGIPDRFSGSGSGTDFTLTISRLEPEDFAVYYCQSYGIEIDITFGGGTKVEIK

SEQ ID NO: 3336 - protein, 110 aa, Artificial Sequence
  Description of Artificial Sequence: Synthetic polypeptide
EIVLTQSPGTLSLSPGERATLSCRASSGDIGHSYVSWYQQKPGQAPRLVIYADDQRPTGIPDRFSGSGSGTDFTLTISRLEPEDFAVYYCQSYGIIIDVTFGGGTKVEIK

SEQ ID NO: 3337 - protein, 110 aa, Artificial Sequence
  Description of Artificial Sequence: Synthetic polypeptide
EIVLTQSPGTLSLSPGERATLSCRASSGDISDSYVSWYQQKPGQAPRLLIYSDDQRPSGIPDRFSGSGSGTDFTLTISRLEPEDFAVYYCQSYGIIIDIVFGGGTKVEIK

SEQ ID NO: 3338 - protein, 110 aa, Artificial Sequence
  Description of Artificial Sequence: Synthetic polypeptide
EIVLTQSPGTLSLSPGERATLSCRASSGSIGHSYVSWYQQKPGQAPRLVIYGDDQRATGIPDRFSGSGSGTDFTLTISRLEPEDFAVYYCQSYDVDIDVVFGGGTKVEIK

SEQ ID NO: 3339 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYVDDQRPSGIPDRFSGSGSGTDFTLTISRLEPEDFAVYYCQSYDINIDIVFGGGTKVEIK

SEQ ID NO: 3340 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVCGGGTKVEIK

SEQ ID NO: 3341 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPGRFSGSGSGTDFTLTISRLEPEDFAVYYCQSYDINIDIVFGGGTKVEIK

SEQ ID NO: 3342 - protein, 110 aa, Artificial Sequence
  Description of Artificial Sequence: Synthetic polypeptide
EIVLTQSPGTLSLSPGERATLSCERSSGDIGDFYVSWYQQKPGQAPRLVIYADDQRPSGIPDRFSGSGSGTDFTLTISRLEPEDFAVYYCQSYDINIDIVFGGGTKVEIK

SEQ ID NO: 3343 - protein, 110 aa, Artificial Sequence
  Description of Artificial Sequence: Synthetic polypeptide
EIVLTQSPGTLSLSPGERATLSCERSSGDIGDYYVSWYQQKPGQAPRLVIYADDQRPSGIPDRFSGSGSGTDFTLTINRMEPEDFAVYYCQSYDINMDIVFGGGTKVEIK

SEQ ID NO: 3344 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYGDDQRPSGIPDRFSGSGSGTDFTLTISRLEPEDFAVYYCQSYDINIDIVFGGGTKVEIK

SEQ ID NO: 3345 - protein, 110 aa, Artificial Sequence
  Description of Artificial Sequence: Synthetic polypeptide
EIVLTQSPGTLSLSPGERATLSCRASSGSISYSYVSWYQQKPGQAPRLVIYADDLRATGIPDRFSGSGSGTDFTLTISRLEPEDFAVYYCQSYGINIDVVFGGGTKVEIK

SEQ ID NO: 3346 - protein, 110 aa, Artificial Sequence
  Description of Artificial Sequence: Synthetic polypeptide
EIVLTQSPGTLSLSPGERATLSCERSSGDIWYSYVSWYQQKPGQAPRLLIYADDQRASGIPYRFSGSGSGTDFTLTISRLEPEDFAVYYCQSYDINVDTVFGGGTKVEIK

SEQ ID NO: 3347 - protein, 110 aa, Artificial Sequence
  Description of Artificial Sequence: Synthetic polypeptide
EIVLTQSPGTLSLSPGERATLSCERSSGSIGDAYVSWYQQKPGQAPRLVIYSDDQRPSGIPDRFSGSGSGTDFTLTISRLEPEDFAVYYCQSYGIIVDVVFGGGTKVEIK

SEQ ID NO: 3348 - protein, 110 aa, Artificial Sequence
  Description of Artificial Sequence: Synthetic polypeptide
EIVLTQSPGTLSLSPGERATLSCRASSGSIGDSYVSWYQQKPGQAPRLVIYADDQRASGIPDRFSGSGSGTDFTLTISRLEPEDFAVYYCQSYGIAIDIVFGGGTKVEIK

SEQ ID NO: 3349 - protein, 110 aa, Artificial Sequence
  Description of Artificial Sequence: Synthetic polypeptide
EIVLTQSPGTLSLSPGERATLSCRASSGSIEYSYVSWYQQKPGQAPRLVIYADDQRASGIPDRFSGSGSGTDFTLTISRLEPEDFAVYYCQSYGIIVDIVFGGGTKVEIK

SEQ ID NO: 3350 - protein, 110 aa, Artificial Sequence
  Description of Artificial Sequence: Synthetic polypeptide
EIVLTQSPGTLSLSPGERATLSCRASSGSIEGAYVSWYQQKPGQAPRLVIYSDDERATGIPDRFSGSGSGTDFTLTISRLEPEDFAVYYCQSYGIITDIVFGGGTKVEIK

SEQ ID NO: 3351 - protein, 110 aa, Artificial Sequence
  Description of Artificial Sequence: Synthetic polypeptide
EIVLTQSPGTLSLSPGERATLSCERSSGSIGGTYVSWYQQKPGQAPRLVIYADDLRASGIPDRFSGSGSGTDFTLTISRLEPEDFAVYYCQSYDIEIDITFGGGTKVEIK

SEQ ID NO: 3352 - protein, 110 aa, Artificial Sequence
  Description of Artificial Sequence: Synthetic polypeptide
EIVLTQSPGTLSLSPGERATLSCERSSGDIGSCYVSWYQQKPGQAPRLVIYADDQRASGIPDRFSGSGSGTDFTLTISRLEPEDFAVYYCQSYDIDIDVVFGGGTKVEIK

SEQ ID NO: 3353 - protein, 110 aa, Artificial Sequence
  Description of Artificial Sequence: Synthetic polypeptide
EIVLTQSPGTLSLSPGERATLSCRASSGDIGYTYVSWYQQKPGQAPRLVIYADDVRPSGIPDRFSGSGSGTDFTLTISRLEPEDFAVYYCQSYGIDVDIVFGGGTKVEIK

SEQ ID NO: 3354 - protein, 110 aa, Artificial Sequence
  Description of Artificial Sequence: Synthetic polypeptide
EIVLTQSPGTLSLSPGERATLSCERSSGSIWGYYVSWYQQKPGQAPRLVIYADDHRASGIPDRFSGSGSGTDFTLTISRLEPEDFAVYYCQSYDIIIDITFGGGTKVEIK

SEQ ID NO: 3355 - protein, 110 aa, Artificial Sequence
  Description of Artificial Sequence: Synthetic polypeptide
EIVLTQSPGTLSLSPGERATLSCERSSGDIGEAYVSWYQQKPGQAPRLVIYADDQRPSGIPDRFSGSGSGTDFTLTISRLEPEDFAVYYCQSYDIIIDITFGGGTKVEIK

SEQ ID NO: 3356 - protein, 110 aa, Artificial Sequence
  Description of Artificial Sequence: Synthetic polypeptide
EIVLTQSPGTLSLSPGERATLSCERSSGDIGYSYVSWYQQKPGQAPRLLIYSDDNRASGIPDRFSGSGSGTDFTLTISRLEPEDFAVYYCQSYGTIIDITFGGGTKVEIK

SEQ ID NO: 3357 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQSYDITIDIVFGGGTKVEIK

SEQ ID NO: 3358 - protein, 110 aa, Artificial Sequence
  Description of Artificial Sequence: Synthetic polypeptide
EIVLTQSPGTLSLSPGERATLSCERSSGDIWYSYVSWYQQKPGQAPRLLIYADDQRATGIPDRFSGSGSGTDFTLTISRLEPEDFAVYYCQSYDLIIDVVFGGGTKVEIK

SEQ ID NO: 3359 - protein, 110 aa, Artificial Sequence
  Description of Artificial Sequence: Synthetic polypeptide
EIVLTQSPGTLSLSPGERATLSCERSSGDIWHSYVSWYQQKPGQAPRLVIYADDQRPSGIPDRFSGSGSGTDFTLTISRLEPEDFAVYYCQSYDIIIDITFGGGTKVEIK

SEQ ID NO: 3360 - protein, 110 aa, Artificial Sequence
  Description of Artificial Sequence: Synthetic polypeptide
EIVLTQSPGTLSLSPGERATLSCRASSGDIGDSYVSWYQQKPGQAPRLVIYADDDRPSGIPDRFSGSGSGTDFTLTISRLEPEDFAVYYCQSYGIDVDVTFGGGTKVEIK

SEQ ID NO: 3361 - protein, 110 aa, Artificial Sequence
  Description of Artificial Sequence: Synthetic polypeptide
EIVLTQSPGTLSLSPGERATLSCRASSGDIAHSYVSWYQQKPGQAPRLLIYVDDLRATGIPDRFSGSGSGTDFTLTISRLEPEDFAVYYCQSYDITIDIVFGGGTKVEIK

SEQ ID NO: 3362 - protein, 110 aa, Artificial Sequence
  Description of Artificial Sequence: Synthetic polypeptide
EIVLTQSPGTLSLSPGERATLSCERSSGDIYSYYVSWYQQKPGQAPRLLIYSDDQRPSGIPDRFSGSGSGTDFTLTISRLEPEDFAVYYCQSYDLNIDVVFGGGTKVEIK

SEQ ID NO: 3363 - protein, 110 aa, Artificial Sequence
  Description of Artificial Sequence: Synthetic polypeptide
EIVLTQSPGTLSLSPGERATLSCRASSGDISESYVSWYQQKPGQAPRLLIYTDDLRPTGIPDRFSGSGSGTDFTLTISRLEPEDFAVYYCQSYDIDTDIVFGGGTKVEIK

SEQ ID NO: 3364 - protein, 110 aa, Artificial Sequence
  Description of Artificial Sequence: Synthetic polypeptide
EIVLTQSPGTLSLSPGERATLSCERSSGDIGDSLVSWYQQKPGQAPRLVIYADDQRASGIPDRFSGSGSGTDFTLTISRLEPEDFAVYYCQSYGVIVDIVFGGGTKVEIK

SEQ ID NO: 3365 - protein, 110 aa, Artificial Sequence
  Description of Artificial Sequence: Synthetic polypeptide
EIVLTQSPGTLSLSPGERATLSCRASSGDIYESYVSWYQQKPGQAPRLVIYADDQRATGIPDRFSGSGSGTDFTLTISRLEPEDFAVYYCQSYDVTIDIVFGGGTKVEIK

SEQ ID NO: 3366 - protein, 110 aa, Artificial Sequence
  Description of Artificial Sequence: Synthetic polypeptide
EIVLTQSPGTLSLSPGERATLSCERSSGDIGFAYVSWYQQKPGQAPRLLIYADDQRASGIPDRFSGSGSGTDFTLTISRLEPEDFAVYYCQSYGIDIDIVFGGGTKVEIK

SEQ ID NO: 3367 - protein, 110 aa, Artificial Sequence
  Description of Artificial Sequence: Synthetic polypeptide
EIVLTQSPGTLSLSPGERAPLSCERSSGSIWDSYVSWYQQKPGQAPRLVIYADDQRASGIPDRFSGSGSGTDFTLTISRLEPEDFAVYYCQSYDVDIDIVFGGGTKVEIK

SEQ ID NO: 3368 - protein, 110 aa, Artificial Sequence
  Description of Artificial Sequence: Synthetic polypeptide
EIVLTQSPGTLSLSPGERATLSCERSSGDIWDSYVSWYQQKPGQAPRLVIYSDDQRATGIPDRFSGSGSGTDFTLTISRLEPEDFAVYYCQSYGIIIDITFGGGTKVEIK

SEQ ID NO: 3369 - protein, 110 aa, Artificial Sequence
  Description of Artificial Sequence: Synthetic polypeptide
EIVLTQSPGTLSLSPGERATLSCRASSGSIGYSYVSWYQQKPGQAPRLVIYADDRRASGIPDRFSGSGSGTDFTLTISRLEPEDFAVYYCQSYDIIRDIVFGGGTKVEIK

SEQ ID NO: 3370 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQSYGIIVDIVFGGGTKVEIK

SEQ ID NO: 3371 - protein, 110 aa, Artificial Sequence
  Description of Artificial Sequence: Synthetic polypeptide
EIVLTQSPGTLSLSPGERATLSCRASSGSIWYSYVSWYQQKPGQAPRLVIYSDDQRASGIPDRFSGSGSGTDFTLTISRLEPEDFAVYYCQSYGINIDVTFGGGTKVEIK

SEQ ID NO: 3372 - protein, 110 aa, Artificial Sequence
  Description of Artificial Sequence: Synthetic polypeptide
EIVLTQSPGTLSLSPGERATLSCERSSGDIWDSYVSWYQQKPGQAPRLVIYSDDQRPSGIPDRFSGSGSGTDFTLTISRLEPEDFAVYYCQSYGIIIDIVFGGGTKVEIK

SEQ ID NO: 3373 - protein, 110 aa, Artificial Sequence
  Description of Artificial Sequence: Synthetic polypeptide
EIVLTQSPGTLSLSPGERATLSCERSSGDIGYFYVSWYQQKPGQAPRLVIYVDDQRASGIPDRFSGSGSGTDFTLTISRLEPEDFAVYYCQSYGINIDVVFGGGTKVEIK

SEQ ID NO: 3374 - protein, 110 aa, Artificial Sequence
  Description of Artificial Sequence: Synthetic polypeptide
EIVLTQSPGTLSLSPGERATLSCRASSGSIGDTYVSWYQQKPGQAPRLLIYSDDHRPTGIPDRFSGSGSGTDFTLTISRLEPEDFAVYYCQSYDINIDIVFGGGTKVEIK

SEQ ID NO: 3375 - protein, 110 aa, Artificial Sequence
  Description of Artificial Sequence: Synthetic polypeptide
EIVLTQSPGTLSLSPGERATLSCRASSGDIWYSFVSWYQQKPGQAPRLLIYADDQRATGIPDRFSGSGSGTDFTLTISRLEPEDFAVYYCQSYGIISDIVFGGGTKVEIK

SEQ ID NO: 3376 - protein, 110 aa, Artificial Sequence
  Description of Artificial Sequence: Synthetic polypeptide
EIVLTQSPGTLSLSPGERATLSCERSSGSIGETYVSWYQQKPGQAPRLVIYADDLRATGIPDRFSGSGSGTDFTLTISRLEPEDFAVYYCQSYGIIVDIVFGGGTKVEIK

SEQ ID NO: 3377 - protein, 110 aa, Artificial Sequence
  Description of Artificial Sequence: Synthetic polypeptide
EIVLTQSPGTLSLSPGERATLSCRASSGDIGDCFVSWYQQKPGQAPRLVIYADDQRPSGIPDRFSGSGSGTDFTLTISRLEPEDFAVYYCQSYGINIDVVFGGGTKVEIK

SEQ ID NO: 3378 - protein, 110 aa, Artificial Sequence
  Description of Artificial Sequence: Synthetic polypeptide
EIVLTQSPGTLSLSPGERATLSCRASSGDIRHSFVSWYQQKPGQAPRLVIYWDDYRPSGIPDRFSGSGSGTDFTLTISRLEPEDFAVYYCQSYDIDIDVTFGGGTKVEIK

SEQ ID NO: 3379 - protein, 110 aa, Artificial Sequence
  Description of Artificial Sequence: Synthetic polypeptide
EIVLTQSPGTLSLSPGERATLSCERSSGSIDECYVSWYQQKPGQAPRLVIYADDDRATGIPDRFSGSGSGTDFTLTISRLEPEDFAVYYCQSYDIDIDVVFGGGTKVEIK

SEQ ID NO: 3380 - protein, 110 aa, Artificial Sequence
  Description of Artificial Sequence: Synthetic polypeptide
EIVLTQSPGTLSLSPGERATLSCERSSGDIGESYVSWYQQKPGQAPRLVIYTDDRRASGIPDRFSGSGSGTDFTLTISRLEPEDFAVYYCQSYGSNIDVVFGGGTKVEIK

SEQ ID NO: 3381 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQQYDIDTDIVFGGGTKVEIK

SEQ ID NO: 3382 - protein, 110 aa, Artificial Sequence
  Description of Artificial Sequence: Synthetic polypeptide
EIVLTQSPGTLSLSPGERATLSCERSSGDIGHSYVSWYQQKPGQAPRLVIYSDDQRASGIPDRFSGSGSGTDFTLTISRLEPEDFAVYYCQSYDIIIDITFGGGTKVEIK

SEQ ID NO: 3383 - protein, 110 aa, Artificial Sequence
  Description of Artificial Sequence: Synthetic polypeptide
EIVLTQSPGTLSLSPGERATLSCRASSGDICHSYVSWYQQKPGQAPRLVIYADDQRATGIPDRFSGSGSGTDFTLTISRLEPEDFAVYYCQSYDIIVDIVFGGGTKVEIK

SEQ ID NO: 3384 - protein, 110 aa, Artificial Sequence
  Description of Artificial Sequence: Synthetic polypeptide
EIVLTQSPGTLSLSPGERATLSCERSSGSINESYVSWYQQKPGQAPRLVIYADDQRASGIPDRFSGSGSGTDFTLTISRLEPEDFAVYYCQSYGIDIDIVFGGGTKVEIK

SEQ ID NO: 3385 - protein, 110 aa, Artificial Sequence
  Description of Artificial Sequence: Synthetic polypeptide
EIVLTQSPGTLSLSPGERATLSCERSSGSIWYSYVSWYQQKPGQAPRLLIYADDQRASGIPDRFSGSGSGTDFTLTISRLEPEDFAVYYCQSYDIDIDVTFGGGTKVEIK

SEQ ID NO: 3386 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYADDERASRIPDRFSGSGSGTDFTLTISRLEPEDFAVYYCQSYGIDIDVVFGGGTKVEIK

SEQ ID NO: 3387 - protein, 110 aa, Artificial Sequence
  Description of Artificial Sequence: Synthetic polypeptide
EIVLTQSPGTLSLSPGERATLSCRASSGDIWYSYVSWYQQKPGQAPRLVIYADDQRPTGIPDRFSGSGSGTDFTLTISRLEPEDFAVYYCQSYDIDIDITFGGGTKVEIK

SEQ ID NO: 3388 - protein, 110 aa, Artificial Sequence
  Description of Artificial Sequence: Synthetic polypeptide
EIVLTQSPGTLSLSPGERATLSCERSSGDIWQSYVSWYQQKPGQAPRLLIYADDQRASGIPDRFSGSGSGTDFTLTISRLEPEDFAVYYCQSYDIVIDITFGGGTKVEIK

SEQ ID NO: 3389 - protein, 110 aa, Artificial Sequence
  Description of Artificial Sequence: Synthetic polypeptide
EIVLTQSPGTLSLSPGERATLSCERSSGDIWYSYVSWYQQKPGQAPRLLIYSDDQRASGIPDRFSGSGSGTDFTLTISRLEPEDFAVYYCQSYDIIIDIVFGGGTKVEIK

SEQ ID NO: 3390 - protein, 110 aa, Artificial Sequence
  Description of Artificial Sequence: Synthetic polypeptide
EIVLTQSPGTLSLSPGERATLSCERSSGDIGDYYVSWYQQKPGQAPRLVIYSDDQRPTGIPDRFSGSGSGTDFTLTISRLEPEDFAVYYCQSYDLIIDITFGGGTKVEIK

SEQ ID NO: 3391 - protein, 110 aa, Artificial Sequence
  Description of Artificial Sequence: Synthetic polypeptide
EIVLTQSPGTLSLSPGERATLSCRASSGDIGYTYVSWYQQKPGQAPRLVIYSDDHRASGIPDRFSGSGSGTDFTLTISRLEPEDFAVYYCQSYGIIVDIVFGGGTKVEIK

SEQ ID NO: 3392 - protein, 110 aa, Artificial Sequence
  Description of Artificial Sequence: Synthetic polypeptide
EIVLTQSPGTLSLSPGERATLSCERSSGDISGAYVSWYQQKPGQAPRLVIYGDDERASGIPDRFSGSGSGTDFTLTISRLEPEDFAVYYCQSYDIIIDVTFGGGTKVEIK

SEQ ID NO: 3393 - protein, 110 aa, Artificial Sequence
  Description of Artificial Sequence: Synthetic polypeptide
EIVLTQSPGTLSLSPGERATLSCRASSGDIGRSYVSWYQQKPGQAPRLVIYADDLRASGIPDRFSGSGSGTDFTLTISRLEPEDFAVYYCQSYDVNTDIVFGGGTKVEIK

SEQ ID NO: 3394 - protein, 110 aa, Artificial Sequence
  Description of Artificial Sequence: Synthetic polypeptide
EIVLTQSPGTLSLSPGERATLSCERSSGSIWHTYVSWYQQKPGQAPRLVIYADDQRPSGIPDRFSGSGSGTDFTLTISRLEPEDFAVYYCQSYGIIIDITFGGGTKVEIK

SEQ ID NO: 3395 - protein, 110 aa, Artificial Sequence
  Description of Artificial Sequence: Synthetic polypeptide
EIVLTQSPGTLSLSPGERATLSCERSSGDIGYAYVSWYQQKPGQAPRLLIYADDQRASGIPDRFSGSGSGTDFTLTISRLEPEDFAVYYCQSYDIILDVTFGGGTKVEIK

SEQ ID NO: 3396 - protein, 110 aa, Artificial Sequence
  Description of Artificial Sequence: Synthetic polypeptide
  MOD_RES (81)..(81): Any amino acid
EIVLTQSPGTLSLSPGERATLSCRASSGDIEHSYVSWYQQKPGQAPRLLIYVDDQRPTGIPDRFSGSGSGTDFTLTISRLXPEDFAVYYCQSYGIREDIVFGGGTKVEIK

SEQ ID NO: 3397 - protein, 110 aa, Artificial Sequence
  Description of Artificial Sequence: Synthetic polypeptide
EIVLTQSPGTLSLSPGERATLSCERSSGSIGFSYVSWYQQKPGQAPRLVIYADDLRATGIPDRFSGSGSGTDFTLTISRLEPEDFAVYYCQSYGTYVDVVFGGGTKVEIK

SEQ ID NO: 3398 - protein, 110 aa, Artificial Sequence
  Description of Artificial Sequence: Synthetic polypeptide
EIVLTQSPGTLSLSPGERATLSCRASSGDIWYSYVSWYQQKPGQAPRLVIYSDDERPTGIPDRFSGSGSGTDFTLTISRLEPEDFAVYYCQSYGVDVDVVFGGGTKVEIK

SEQ ID NO: 3399 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQSYDIIIDIVFGGGTKVEIK

SEQ ID NO: 3400 - protein, 110 aa, Artificial Sequence
  Description of Artificial Sequence: Synthetic polypeptide
EIVLTQSPGTLSLSPGERATLSCRASSGDIEHSYVSWYQQKPGQAPRLLIYADDYRPTGIPDRFSGSGSGTDFTLTISRLEPEDFAVYYCQSYGIDPDITFGGGTKVEIK

SEQ ID NO: 3401 - protein, 110 aa, Artificial Sequence
  Description of Artificial Sequence: Synthetic polypeptide
EIVLTQSPGTLSLSPGERATLSCRASSGDISHSYVSWYQQKPGQAPRLVIYADDQRATGIPDRFSGSGSGTDFTLTISRLEPEDFAVYYCQSYDIDIDITFGGGTKVEIK

SEQ ID NO: 3402 - protein, 110 aa, Artificial Sequence
  Description of Artificial Sequence: Synthetic polypeptide
EIVLTQSPGTLSLSPGERATLSCERSSGDIGDAYVSWYQQKPGQAPRLVIYADDQRASGIPDRFSGSGSGTDFTLTISRLEPEDFAVYYCQSYGIFIDIVFGGGTKVEIK

SEQ ID NO: 3403 - protein, 110 aa, Artificial Sequence
  Description of Artificial Sequence: Synthetic polypeptide
EIVLTQSPGTLSLSPGERATLSCERSSGDIGEYYVSWYQQKPGQAPRLVIYADDRRPTGIPDRFSGSGSGTDFTLTISRLEPEDFAVYYCQSYDIDIDVTFGGGTKVEIK

SEQ ID NO: 3404 - protein, 110 aa, Artificial Sequence
  Description of Artificial Sequence: Synthetic polypeptide
EIVLTQSPGTLSLSPGERATLSCERSSGSIDYAYVSWYQQKPGQAPRLVIYSDDYRATGIPDRFSGSGSGTDFTLTISRLEPEDFAVYYCQSYDIDIDITFGGGTKVEIK

SEQ ID NO: 3405 - protein, 110 aa, Artificial Sequence
  Description of Artificial Sequence: Synthetic polypeptide
EIVLTQSPGTLSLSPGERATLSCRASSGDIWYSYVSWYQQKPGQAPRLLIYADDQRASGIPDRFSGSGSGTDFTLTISRLEPEDFAVYYCQSYGIVIDIVFGGGTKVEIK

SEQ ID NO: 3406 - protein, 110 aa, Artificial Sequence
  Description of Artificial Sequence: Synthetic polypeptide
EIVLTQSPGTLSLSPGERATLSCERSSGSIGYSYVSWYQQKPGQAPRLVMYADDQRASGIPDRFSGSGSGTDFTLTISRLEPEDFAVYYCQSYDVIIDVVFGGGTKVEIK

SEQ ID NO: 3407 - protein, 110 aa, Artificial Sequence
  Description of Artificial Sequence: Synthetic polypeptide
EIVLTQSPGTLSLSPGERATLSCRASSGDIGYSYVSWYQQKPGQAPRLVIYSDDQRASGIPDRFSGSGSGTDFTLTISRLEPEDFAVYYCQSYDIIIDVTFGGGTKVEIK

SEQ ID NO: 3408 - protein, 110 aa, Artificial Sequence
  Description of Artificial Sequence: Synthetic polypeptide
EIVLTQSPGTLSLSPGERATLSCRASSGSIWHSYVSWYQQKPGQAPRLVIYADDQRATGIPDRFSGSGSGTDFTLTISRLEPEDFAVYYCKSYGINIDVTFGGGTKVEIK

SEQ ID NO: 3409 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYSDDQRPSGIPDRFSGSGSGTDFTLTISRLEPEDFAVYYCQSYDINIDVVFGGGTKVEIK

SEQ ID NO: 3410 - protein, 110 aa, Artificial Sequence
  Description of Artificial Sequence: Synthetic polypeptide
EIVLTQSPGTLSLSPGERATLSCERSSGDIGDTYVSWYQQKPGQAPRLVIYADDQRASGIPDRFSGSGSGTDFTLTISRLEPEDFAVYYCQSYGIDIDITFGGGTKVEIK

SEQ ID NO: 3411 - protein, 110 aa, Artificial Sequence
  Description of Artificial Sequence: Synthetic polypeptide
EIVLTQSPGTLSLSPGERATLSCRASSGDIRHSYVSWYQQKPGQAPRLVIYADDDRASGIPDRFSGSGSGTDFTLTISRLEPEDFAVYYCQSYGINTDIVFGGGTKVEIK

SEQ ID NO: 3412 - protein, 110 aa, Artificial Sequence
  Description of Artificial Sequence: Synthetic polypeptide
EIVLTQSPGTLSLSPGERATLSCRASSGDIGGSYVSWYQQKPGQAPRLVIYTDDWRASGIPDRFSGSGSGTDFTLTISRLEPEDFAVYYCQSYGINIDVVFGGGTKVEIK

SEQ ID NO: 3413 - protein, 110 aa, Artificial Sequence
  Description of Artificial Sequence: Synthetic polypeptide
EIVLTQSPGTLSLSPGERATLSCRASSGDISYSYVSWYQQKPGQAPRLLIYADDQRATGIPDRFSGSGSGTDFTLTISRLEPEDFAVYYCQSYGIIIDVVFGGGTKVEIK

SEQ ID NO: 3414 - protein, 110 aa, Artificial Sequence
  Description of Artificial Sequence: Synthetic polypeptide
EIVLTQSPGTLSLSPGERATLSCERSSGDIGDMYVSWYQQKPGQAPRLVIYSDDQRPSGIPDRFSGSGSGTDFTLTISRLEPEDFAVYYCQSYDIIIDIVFGGGTKVEIK

SEQ ID NO: 3415 - protein, 110 aa, Artificial Sequence
  Description of Artificial Sequence: Synthetic polypeptide
EIVLTQSPGTLSLSPGERATLSCERSSGDIDYTYVSWYQQKPGQAPRLLIYADDQRASGIPDRFSGSGSGTDFTLTISRLEPEDFAVYYCQSYDLTLDITFGGGTKVEIK

SEQ ID NO: 3416 - protein, 110 aa, Artificial Sequence
  Description of Artificial Sequence: Synthetic polypeptide
EIVLTQSPGTLSLSPGERATLSCERSSSSIWHSYVSWYQQKPGQAPRLVIYADDYRASGIPDRFSGSGSGTDFTLTISRLEPEDFAVYYCQSYDIDIDVVFGGGTKVEIK

SEQ ID NO: 3417 - protein, 110 aa, Artificial Sequence
  Description of Artificial Sequence: Synthetic polypeptide
EIVLTQSPGTLSLSPGERATLSCRASSGSIDYSYVSWYQQKPGQAPRLVIYADDQRASGIPDRFSGSGSGTDFTLTISRLEPEDFAVYYCQSYGIYIDVVFGGGTKVEIK

SEQ ID NO: 3418 - protein, 110 aa, Artificial Sequence
  Description of Artificial Sequence: Synthetic polypeptide
EIVLTQSPGTLSLSPGERATLSCRASSGSIWYSFVSWYQQKPGQAPRLVIYADDQRASGIPDRFSGSGSGTDFTLTISRLEPEDFAVYYCQSYGQYIDVVFGGGTKVEIK

SEQ ID NO: 3419 - protein, 110 aa, Artificial Sequence
  Description of Artificial Sequence: Synthetic polypeptide
EIVLTQSPGTLSLSPGERATLSCRASSGDIDESYVSWYQQKPGQAPRLVIYADDQRATGIPDRFSGSGSGTDFTLTISRLEPEDFAVYYCQSYGIIIDIVFGGGTKVEIK

SEQ ID NO: 3420 - protein, 110 aa, Artificial Sequence
  Description of Artificial Sequence: Synthetic polypeptide
  MOD_RES (31)..(31): Any amino acid
EIVLTQSPGTLSLSPGERATLSCRASSGDIXYSYVSWYQQKPGQAPRLVIYSDDQRATGIPDRFSGSGSGTDFTLTISRLEPEDFAVYYCQSYDSIIDVTFGGGTKVEIK

SEQ ID NO: 3421 - protein, 110 aa, Artificial Sequence
  Description of Artificial Sequence: Synthetic polypeptide
EIVLTQSPGTLSLSPGERATLSCRASSGDIWYSYVSWYQQKPGQAPRLLIYADDQRPSGIPDRFSGSGSGTDFTLTISRLEPEDFAVYYCQSYGINVDIVFGGGTKVEIK

SEQ ID NO: 3422 - protein, 110 aa, Artificial Sequence
  Description of Artificial Sequence: Synthetic polypeptide
EIVLTQSPGTLSLSPGERATLSCERSSGSIMYAYVSWYQQKPGQAPRLVIYADDQRPTGIPDRFSGSGSGTDFTLTISRLEPEDFAVYYCQSYDLIIDVTFGGGTKVEIK

SEQ ID NO: 3423 - protein, 110 aa, Artificial Sequence
  Description of Artificial Sequence: Synthetic polypeptide
EIVLTQSPGTLSLSPGERATLSCERSSGDIGDTYVSWYQQKPGQAPRLVIYADDARATGIPDRFSGSGSGTDFTLTISRLEPEDFAVYYCQSYDLDIDITFGGGTKVEIK

SEQ ID NO: 3424 - protein, 110 aa, Artificial Sequence
  Description of Artificial Sequence: Synthetic polypeptide
EIVLTQSPGTLSLSPGERATLSCERSSGDIWHSYVSWYQQKPGQAPRLVIYADDQRASGIPDRFSGSGSGTDFTLTISRLEPEDFAVYYCQSYDISIDVTFGGGTKVEIK

SEQ ID NO: 3425 - protein, 110 aa, Artificial Sequence
  Description of Artificial Sequence: Synthetic polypeptide
EIVLTQSPGTLSLSPGERATLSCERSSGSIGETYVSWYQQKPGQAPRLLIYSDDQRATGIPDRFSGSGSGTDFTLTISRLEPEDFAVYYCQSYGIDIDIVFGGGTKVEIK

SEQ ID NO: 3426 - protein, 110 aa, Artificial Sequence
  Description of Artificial Sequence: Synthetic polypeptide
EIVLTQSPGTLSLSPGERATLSCRASSGSIGDSYVSWYQQKPGQAPRLLIYSDDDRPTGIPDRFSGSGSGTDFTLTISRLEPEDFAVYYCQSYGISIDVTFGGGTKVEIK

SEQ ID NO: 3427 - protein, 110 aa, Artificial Sequence
  Description of Artificial Sequence: Synthetic polypeptide
EIVLTQSPGTLSLSPGERATLSCRASSGDIGHSYVSWYQQKPGQAPRLLIYADDQRASGIPDRFSGSGSGTDFTLTISRLEPEDFAVYYCQSYDIIIDITFGGGTKVEIK

SEQ ID NO: 3428 - protein, 110 aa, Artificial Sequence
  Description of Artificial Sequence: Synthetic polypeptide
EIVLTQSPGTLSLSPGERATLSCERSSGDIGDTYVSWYQQKPGQAPRLVIYSDDQRPSGIPDRFSGSGSGTDFTLTISRLEPEDFAVYYCQSYGIIIDIVFGGGTKVEIK

SEQ ID NO: 3429 - protein, 110 aa, Artificial Sequence
  Description of Artificial Sequence: Synthetic polypeptide
EIVLTQSPGTLSLSPGERATLSCERSSGDIYSYYVSWYQQKPGQAPRLLIYSDDQRPSGIPDRFSGSGSGTDFTLTISRLEPEDFAVYYCQSYGINIDVTFGGGTKVEIK

SEQ ID NO: 3430 - protein, 110 aa, Artificial Sequence
  Description of Artificial Sequence: Synthetic polypeptide
EIVLTQSPGTLSLSPGERATLSCERSSGSIWHSYVSWYQQKPGQAPRLVIYSDDQQASGIPDRFSGSGSGTDFTLTISRLEPEDFAVYYCQSYDIIIDIVFGGGTKVEIK

SEQ ID NO: 3431 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRATGIPDRFSGSGSGTDFTLTISRLEPEDFAVYYCQSYGIVIDIVFGGGTKVEIK

SEQ ID NO: 3432 - protein, 110 aa, Artificial Sequence
  Description of Artificial Sequence: Synthetic polypeptide
EIVLTQSPGTLSLSPGERATLSCERSSGDIGDTYVSWYQQKPGQAPRLVIYADDQRPTGIPDRFSGSGSGTDFTLTISRLEPEDFAVYYCQSYDLTIDIVFGGGTKVEIK

SEQ ID NO: 3433 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYSDDQRASGIPDRFSGSGSGTDFTLTISRLEPEDFAVYYCQSYDICIDVTFGGGTKVEIK

SEQ ID NO: 3434 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYSDDHRPSGIPDRFSGSGSGTDFTLTISRLEPEDFAVYYCQSYGIIIDIVFGGGTKVEIK

SEQ ID NO: 3435 - protein, 110 aa, Artificial Sequence
  Description of Artificial Sequence: Synthetic polypeptide
EIVLTQSPGTLSLSPGERATLSCERSSGSIGGYYVSWYQQKPGQAPRLLIYADDQRATGIPDRFSGSGSGTDFTLTISRLEPEDFAVYYCQSYGIIIDIVFGGGTKVEIK

SEQ ID NO: 3436 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYGADLRASGIPDRFSGSGSGTDFTLTISRLEPEDFAVYYCQSYGIDIDIVFGGGTKVEIK

SEQ ID NO: 3437 - protein, 110 aa, Artificial Sequence
  Description of Artificial Sequence: Synthetic polypeptide
  MOD_RES (27)..(27): Any amino acid
EIVLTQSPGTLSLSPGERATLSCERSXGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3438 - protein, 110 aa, Artificial Sequence
  Description of Artificial Sequence: Synthetic polypeptide
EIVLTQSPGTLSLSPGERATLSCERSSVDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3439 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIHADDQRPSGIPDRFSGSGSGTDFTLTISRLEPEDFAVYYCQSYDINIDIVFGGGTKVEIK

SEQ ID NO: 3440 - protein, 110 aa, Artificial Sequence
  Description of Artificial Sequence: Synthetic polypeptide
EIVLTQSPGTLSLSPGERATLSCERSSGDIGDSYVSWYQQKPVQAPRLVIYADDQRPSGIPDRFSGSGSGTDFTLTISRLEPEDFAVYYCQSYDINIDIVFGGGTKVEIK

SEQ ID NO: 3441 - protein, 110 aa, Artificial Sequence
  Description of Artificial Sequence: Synthetic polypeptide
EIVLTQSPGTLSLSPGERATLSCERSSGDIGDSYVSWYQQKPGQATRLVIYADDQRPSGIPDRFSGSGSGTDFTLTISRLEPEDFAVYYCQSYDINIDIVFGGGTKVEIK

SEQ ID NO: 3442 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYAYDQRPSGIPDRFSGSGSGTDFTLTISRLEPEDFAVYYCQSYDINIDIVFGGGTKVEIK

SEQ ID NO: 3443 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYSDDQRPSGIPDRFSGSGSGTDFTLTISRLEPEDFAVYYCQSYDINIDIVFGGGTKVEIK

SEQ ID NO: 3444 - protein, 110 aa, Artificial Sequence
  Description of Artificial Sequence: Synthetic polypeptide
  MOD_RES (2)..(3): Any amino acid
  MOD_RES (21)..(21): Any amino acid
  MOD_RES (30)..(30): Any amino acid
  MOD_RES (52)..(52): Any amino acid
  MOD_RES (93)..(93): Any amino acid
EXXLTQSPGTLSLSPGERATXSCERSSGDXGDSYVSWYQQKPGQAPRLVIYXDDQRPSGIPDRFSGSGSGTDFTLTISGLEPEDFAVYYCQSXDINMDIVFGGGTKVEIK

SEQ ID NO: 3445 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGVGTKVEIK

SEQ ID NO: 3446 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTISRLEPEDFVVYYCQSYDINIDIVFGGGTKVEIK

SEQ ID NO: 3447 - protein, 110 aa, Artificial Sequence
  Description of Artificial Sequence: Synthetic polypeptide
  MOD_RES (52)..(52): Any amino acid
EIVLTQSPGTLSLSPGERATLSCERSSGDIGDSYVSWYQQKPGQAPRLVIYXDDQRPSGIPDRFSGSGSGGDFTLTISRLEPEDFAVYYCQSYDINIDIVFGGGTKVEIK

SEQ ID NO: 3448 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDQRATGIPDRFSGSGSGTDFTLTISRLEPEDFAVYYCQSYDLEVDIVFGGGTKVEIK

SEQ ID NO: 3449 - protein, 110 aa, Artificial Sequence
  Description of Artificial Sequence: Synthetic polypeptide
EIVLTQSPGTLSLSPGERATLSCERSSGSIWDTYVSWYQQKPGQAPRLVIYSDDQRATGIPDRFSGSGSGTDFTLTISRLEPEDFAVYYCQSYGINVDIVFGGGTKVEIK

SEQ ID NO: 3450 - protein, 110 aa, Artificial Sequence
  Description of Artificial Sequence: Synthetic polypeptide
EIVLTQSPGTLSLSPGERATLSCERSSGDIWGYYVSWYQQKPGQAPRLLIYADDLRASGIPDRFSGSGSGTDFTLTISRLEPEDFAVYYCQSYDINIDVVFGGGTKVEIK

SEQ ID NO: 3451 - protein, 110 aa, Artificial Sequence
  Description of Artificial Sequence: Synthetic polypeptide
EIVLTQSPGTLSLSPGERATLSCERSSGSIYYTYVSWYQQKPGQAPRLVIYADDQRASGIPDRFSGSGSGTDFTLTISRLEPEDFAVYYCQSYDIDVDVVFGGGTKVEIK

SEQ ID NO: 3452 - protein, 110 aa, Artificial Sequence
  Description of Artificial Sequence: Synthetic polypeptide
EIVLTQSPGTLSLSPGERATLSCERSSGDIWGYYVSWYQQKPGQAPRLLIYADDLRASGIPDRFSGSGSGTDFTLTISRLEPEDFAVYYCQSYGIDIDITFGGGTKVEIK

SEQ ID NO: 3453 - protein, 110 aa, Artificial Sequence
  Description of Artificial Sequence: Synthetic polypeptide
EIVLTQSPGTLSLSPGERATLSCERSSGDIWDTYVSWYQQKPGQAPRLVIYADDQRATGIPDRFSGSGSGTDFTLTISRLEPEDFAVYYCQSYGLNVDVVFGGGTKVEIK

SEQ ID NO: 3454 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDHRPSGIPDRFSGSGSGTDFTLTISRLEPEDFAVYYCQSYDIDIDVVFGGGTKVEIK

SEQ ID NO: 3455 - protein, 110 aa, Artificial Sequence
  Description of Artificial Sequence: Synthetic polypeptide
EIVLTQSPGTLSLSPGERATLSCERSSGSIWYSYVSWYQQKPGQAPRLLIYADDQRATGIPDRFSGSGSGTDFTLTISRLEPEDFAVYYCQSYGIITDVTFGGGTKVEIK

SEQ ID NO: 3456 - protein, 110 aa, Artificial Sequence
  Description of Artificial Sequence: Synthetic polypeptide
EIVLTQSPGTLSLSPGERATLSCERSSGDIWGYYVSWYQQKPGQAPRLLIYADDLRASGIPDRFSGSGSGTDFTLTISRLEPEDFAVYYCQSYDINIDVVFGGGTEVEIK

SEQ ID NO: 3457 - protein, 110 aa, Artificial Sequence
  Description of Artificial Sequence: Synthetic polypeptide
EIVLTQSPGTLSLSPGERATLSCERSSGDIYYTYVSWYQQKPGQAPRLVIYADDQRASGIPDRFSGSGSGTDFTLTISRLEPEDFAVYYCQSYGINIDVVFGGGTKVEIK

SEQ ID NO: 3458 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRASGIPDRFSGSGSGTDFTLTISRLEPEDFAVYYCQSYDLDIDVVFGGGTKVEIK

SEQ ID NO: 3459 - protein, 110 aa, Artificial Sequence
  Description of Artificial Sequence: Synthetic polypeptide
EIVLTQSPGTLSLSPGERATLSCERSSGSIWQSYVSWYQQKPGQAPRLVIYADDQRPSGIPDRFSGSGSGTDFTLTISRLEPEDFAVYYCQSYDIIIDIVFGGGTKVEIK

SEQ ID NO: 3460 - protein, 110 aa, Artificial Sequence
  Description of Artificial Sequence: Synthetic polypeptide
EIVLTQSPGTLSLSPGERATLSCKRSSGSIYDTYVSWYQQKPGQAPRLVIYSDDQRPSGIPDRFSGSGSGTDFTLTISRLEPEDFAVYYCQSYDVDSDIVFGGGTKVEIK

SEQ ID NO: 3461 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRPSGIPDRFSGSGSGTDFTLTISRLEPEDFAVYYCQSYGIDIDVTFGGGTKVEIK

SEQ ID NO: 3462 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRASGIPDRFSGSGSGTDFTLTISRLEPEDFAVYYCQSYDLDIDVTFGGGTKVEIK

SEQ ID NO: 3463 - protein, 110 aa, Artificial Sequence
  Description of Artificial Sequence: Synthetic polypeptide
EIVLTQSPGTLSLSPGERATLSCERSSGSIYESYVSWYQQKPGQAPRLLIYSDDQRPTGIPDRFSGSGSGTDFTLTISRLEPEDFAVYYCQSYGIDIDVVFGGGTKVEIK

SEQ ID NO: 3464 - protein, 110 aa, Artificial Sequence
  Description of Artificial Sequence: Synthetic polypeptide
EIVLTQSPGTLSLSPGERATLSCERSSGSIYHTYVSWYQQKPGQAPRLVIYADDQRASGIPDRFSGSGSGTDFTLTISRLEPEDFAVYYCQSYDLDIDVTFGGGTKVEIK

SEQ ID NO: 3465 - protein, 110 aa, Artificial Sequence
  Description of Artificial Sequence: Synthetic polypeptide
EIVLTQSPGTLSLSPGERATLSCERSSGSIYDTYVSWYQQKPGQAPRLVIYSDDQRPTGIPDRFSGSGSGTDFTLTISRLEPEDFAVYYCQSYDLDIDIVFGGGTKVEIK

SEQ ID NO: 3466 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDQRASGIPDRFSGSGSGTDFTLTISRLEPEDFAVYYCQSYDIDVDIVFGGGTKVEIK

SEQ ID NO: 3467 - protein, 110 aa, Artificial Sequence
  Description of Artificial Sequence: Synthetic polypeptide
  MOD_RES (32)..(32): Any amino acid
EIVLTQSPGTLSLSPGERATLSCERSSGDIWXYYVSWYQQKPGQAPRLVIYADDQRPSGIPDRFSGSGSGTDFTLTISRLEPEDFAVYYCQSYDLFIDVTFGGGTKVEIK

SEQ ID NO: 3468 - protein, 110 aa, Artificial Sequence
  Description of Artificial Sequence: Synthetic polypeptide
EIVLTQSPGTLSLSPGERATLSCERSSGDIWHYYVSWYQQKPGQAPRLLIYADDQRASGIPDRFSGSGSGTDFTLTISRLEPEDFAVYYCQSYDLEIDVTFGGGTKVEIK

SEQ ID NO: 3469 - protein, 110 aa, Artificial Sequence
  Description of Artificial Sequence: Synthetic polypeptide
EIVLTQSPGTLSLSPGERATLSCERSSGDIWSYYVSWYQQKPGQAPRLVIYADDQRASGIPDRFSGSGSGTDFTLTISRLEPEDFAVYYCQSYDLTVDVVFGGGTKVEIK

SEQ ID NO: 3470 - protein, 110 aa, Artificial Sequence
  Description of Artificial Sequence: Synthetic polypeptide
EIVLTQSPGTLSLSPGERATLSCERSSGDIWSYYVSWYQQKPGQAPRLVIYADDQRASGIPDRFSGSGSGTDFTLTISRLEPEDFAVYYCQSYDLDIDVTFGGGTKVEIK

SEQ ID NO: 3471 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRATGIPDRFSGSGSGTDFTLTISRLEPEDFAVYYCQSYDIDIDVTFGGGTKVEIK

SEQ ID NO: 3472 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDQRASGIPDRFSGSGSGTDFTLTISRLEPEDFAVYYCQSYDIDIDVTFGGGTKVEIK

SEQ ID NO: 3473 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDQRATGIPDRFSGSGSGTDFTLTISRLEPEDFAVYYCQSYDLDIDVVFGGGTKVEIK

SEQ ID NO: 3474 - protein, 110 aa, Artificial Sequence
  Description of Artificial Sequence: Synthetic polypeptide
EIVLTQSPGTLSLSPGERATLSCRASSGSIYYSYVSWYQQKPGQAPRLVIYADDQRATGIPDRFSGSGSGTDFTLTISRLEPEDFAVYYCQSYDIDIDVVFGGGTKVEIK

SEQ ID NO: 3475 - protein, 110 aa, Artificial Sequence
  Description of Artificial Sequence: Synthetic polypeptide
EIVLTQSPGTLSLSPGERATLSCERYSGDIWYTYVSWYQQKPGQAPRLVIYADDQRATGIPDRFSGSGSGTDFTLTISRLEPEDFAVYYCQSYDIDVDVVFGGGTKVEIK

SEQ ID NO: 3476 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDLRATGIPDRFSGSGSGTDFTLTISRLEPEDFAVYYCQSYDLDIDVTFGGGTKVEIK

SEQ ID NO: 3477 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYADDQRASGIPDRFSGSGSGTDFTLTISRLEPEDFAVYYCQSYDLNIDVVFGGGTKVEIK

SEQ ID NO: 3478 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDLRASGIPDRFSGSGSGTDFTLTISRLEPEDFAVYYCQSYDLDIDVTFGGGTKVEIK

SEQ ID NO: 3479 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYTDDLRASGIPDRFSGSGSGTDFTLTISRLEPEDFAVYYCQSYDIETDIVFGGGTKVEIK

SEQ ID NO: 3480 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYADDQRATGIPDRFSGSGSGTDFTLTISRLEPEDFAVYYCQSYDIDVDVTFGGGTKVEIK

SEQ ID NO: 3481 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYADDQRATGIPDRFSGSGSGTDFTLTISRLEPEDFAVYYCQSYDIYIDVVFGGGTKVEIK

SEQ ID NO: 3482 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYADDQRASGIPDRFSGSGSGTDFTLTISRLEPEDFAVYYCQSYDVCIDVVFGGGTKVEIK

SEQ ID NO: 3483 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDQRPSGIPDRFSGSGSGTDFTLTISRLEPEDFAVYYCQSYDLDIDVVFGGGTKVEIK

SEQ ID NO: 3484 - protein, 110 aa, Artificial Sequence
  Description of Artificial Sequence: Synthetic polypeptide
EIVLTQSPGTLSLSPGERATLSCERSSGSIWYSYVSWYQQKPGQAPRLVIYSDDLRASGIPDRFSGSGSGTDFTLTISRLEPEDFAVYYCQSYDINIDVVFGGGTKVEIK

SEQ ID NO: 3485 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYWDDYRASGIPDRFSGSGSGTDFTLTISRLEPEDFAVYYCQSYGIDVDIVFGGGTKVEIK

SEQ ID NO: 3486 - protein, 110 aa, Artificial Sequence
  Description of Artificial Sequence: Synthetic polypeptide
EIVLTQSPGTLSLSPGERATLSCERSSGDIWSYYVSWYQQKPGQAPRLVIYADDQRASGIPDRFSGSGSGTDFTLTISRLEPEDFAVYYCQSYDLDIDITFGGGTKVEIK

SEQ ID NO: 3487 - protein, 110 aa, Artificial Sequence
  Description of Artificial Sequence: Synthetic polypeptide
EIVLTQSPGTLSLSPGERATLSCERSSGDIWSYYVSWYQQKPGQAPRLVIYADDQRASGIPDRFSGSGSGTDFTLTISRLEPEDFAVYYCQSYDLNIDTVFGGGTKVEIK

SEQ ID NO: 3488 - protein, 110 aa, Artificial Sequence
  Description of Artificial Sequence: Synthetic polypeptide
EIVLTQSPGTLSLSPGERATLSCERSSCDIWQYYVSWYQQKPGQAPRLLIYADDQRATGIPDRFSGSGSGTDFTLIISRLEPEDFAVYYCQSYDLDIDVVFGGGTKVEIK

SEQ ID NO: 3489 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYSDDQRASGIPDRFSGSGSGTDFTLTISRLEPEDFAVYYCQSYDIITDVVFGGGTKVEIK

SEQ ID NO: 3490 - protein, 110 aa, Artificial Sequence
  Description of Artificial Sequence: Synthetic polypeptide
EIVLTQSPGTLSLSPGERATLSCERSSGDIWHTYVSWYQQKPGQAPRLVIYADDQRPTGIPDRFSGSGSGTDFTLTISRLEPEDFAVYYCQSYDVNIDVVFGGGTKVEIK

SEQ ID NO: 3491 - protein, 110 aa, Artificial Sequence
  Description of Artificial Sequence: Synthetic polypeptide
EIVLTQSPGTLSLSPGERATLSCERSSGSIWSTYVSWYQQKPGQAPRLLIYSDDQRATGIPDRFSGSGSGTDFTLTISRLEPEDFAVYYCQSYDVVIDIVFGGGTKVEIK

SEQ ID NO: 3492 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYSDDQRASGIPDRFSGSGSGTDFTLTISRLEPEDFAVYYCQSYDLIIDIVFGGGTKVEIK

SEQ ID NO: 3493 - protein, 110 aa, Artificial Sequence
  Description of Artificial Sequence: Synthetic polypeptide
EIVLTQSPGTLSLSPGERATLSCERSSGDIWHYYVSWYQQKPGQAPRLLIYADDQRASGIPDRFSGSGSGTDFTLTISRLEPEDFAVYYCQSYDLDIDVTFGGGTKVEIK

SEQ ID NO: 3494 - protein, 110 aa, Artificial Sequence
  Description of Artificial Sequence: Synthetic polypeptide
EIVLTQSPGTLSLSPGERATLSCERSSGSIWGYYVSWYQQKPGQAPRLVIYADDHRASGIPDRFSGSGSGTDFTLTISRLEPEDFAVYYCQSYDETIDIVFGGGTKVEIK

SEQ ID NO: 3495 - protein, 110 aa, Artificial Sequence
  Description of Artificial Sequence: Synthetic polypeptide
EIVLTQSPGTLSLSPGERATLSCERSSGDIYYTYVSWYQQKPGQAPRLVIYADDQRASGIPDRFSGSGSGTDFTLTISRLEPEDFAVYYCQSYDIDIDITFGGGTKVEIK

SEQ ID NO: 3496 - protein, 110 aa, Artificial Sequence
  Description of Artificial Sequence: Synthetic polypeptide
EIVLTQSPGTLSLSPGERATLSCERSSGDIWQSYVSWYQQKPGQAPRLVIYSDDQRASGIPDRFSGSGSGTDFTLTISRLEPEDFAVYYCQSYDIDVDIVFGGGTKVEIK

SEQ ID NO: 3497 - protein, 110 aa, Artificial Sequence
  Description of Artificial Sequence: Synthetic polypeptide
EIVLTQSPGTLSLSPGERATLSCRASSGSIWYSFVSWYQQKPGQAPRLVIYSDDQRASGIPDRFSGSGSGTDFTLTISRLEPEDFAVYYCQSYGINIDVVFGGGTKVEIK

SEQ ID NO: 3498 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYSDDQRATGIPDRFSGSGSGTDFTLTISRLEPEDFAVYYCQSYGTNIDVVFGGGTKVEIK

SEQ ID NO: 3499 - protein, 110 aa, Artificial Sequence
  Description of Artificial Sequence: Synthetic polypeptide
EIVLTQSPGTLSLSPGERATLSCERSSGDIWESYVSWYQQKPGQAPRLVIYADDQRPTGIPDRFSGSGSGTDFTLTISRLEPEDFAVYYCQSYGIIDDIVFGGGTKVEIK

SEQ ID NO: 3500 - protein, 110 aa, Artificial Sequence
  Description of Artificial Sequence: Synthetic polypeptide
EIVLTQSPGTLSLSPGERATLSCERSSGDIWETYVSWYQQKPGQAPRLVIYSDDQRPSGIPDRFSGSGSGTDFTLTISRLEPEDFAVYYCQSYDIDIDVTFGGGTKVEIK

SEQ ID NO: 3501 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDQRATGIPDRFSGSGSGTDFTLTISRLEPEDFAVYYCQSYDIDIDVVFGGGTKVEIK

SEQ ID NO: 3502 - protein, 110 aa, Artificial Sequence
  Description of Artificial Sequence: Synthetic polypeptide
EIVLTQSPGTLSLSPGERATLSCERSSGDIGDSYVSWYQQKPGQAPRLLIYADDQRASGIPDRFSGSGSGTDFTLTISRLEPEDFAVYYCQSYGLNIDVVFGGGTKVEIK

SEQ ID NO: 3503 - protein, 110 aa, Artificial Sequence
  Description of Artificial Sequence: Synthetic polypeptide
EIVLTQSPGTLSLSPGERATLSCERSSGDIWSYYVSWYQQKPGQAPRLLIYADDQRATGIPDRFSGSGSGTDFTLTISRLEPEDFAVYYCQSYDICIDVTFGGGTKVEIK

SEQ ID NO: 3504 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDQRASGIPDRFSGSGSGTDFTLTISRLEPEDFAVYYCQSYDIDIDIVFGGGTKVEIK

SEQ ID NO: 3505 - protein, 110 aa, Artificial Sequence
  Description of Artificial Sequence: Synthetic polypeptide
EIVLTQSPGTLSLSPGERATLSCERSSGDIYDAYVSWYQQKPGQAPRLVIYADDQRASGIPDRFSGSGSGTDFTLTISRLEPEDFAVYYCQSYDIDVDVVFGGGTKVEIK

SEQ ID NO: 3506 - protein, 110 aa, Artificial Sequence
  Description of Artificial Sequence: Synthetic polypeptide
EIVLTQSPGTLSLSPGERATLSCERSSGSIWDTYVSWYQQKPGQAPRLVIYSDDQRPSGIPDRFSGSGSGTDFTLTISRLEPEDFAVYYCQSYDIDIDVVFGGGTKVEIK

SEQ ID NO: 3507 - protein, 110 aa, Artificial Sequence
  Description of Artificial Sequence: Synthetic polypeptide
EIVLTQSPGTLSLSPGERATLSCERSSGSIWQYYVSWYQQKPGQAPRLLIYADDKRASGIPDRFSGSGSGTDFTLTISRLEPEDFAVYYCQSYDEDIDITFGGGTKVEIK

SEQ ID NO: 3508 - protein, 110 aa, Artificial Sequence
  Description of Artificial Sequence: Synthetic polypeptide
EIVLTQSPGTLSLSPGERATLSCERSSGDIWSYYVSWYQQKPGQAPRLVIYADDQRASGIPDRFSGSGSGTDFTLTISRLEPEDFAVYYCQSYDLNIDVTFGGGTKVEIK

SEQ ID NO: 3509 - protein, 110 aa, Artificial Sequence
  Description of Artificial Sequence: Synthetic polypeptide
EIVLTQSPGTLSLSPGERATLSCERSSGDIWSYYVSWYQQKPGQAPRLLIYADDQRATGIPDRFSGSGSGTDFTLTISRLEPEDFAVYYCQSYDLYIDIVFGGGTKVEIK

SEQ ID NO: 3510 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDMRASGIPDRFSGSGSGTDFTLTISRLEPEDFAVYYCQSYDLNIDVTFGGGTKVEIK

SEQ ID NO: 3511 - protein, 110 aa, Artificial Sequence
  Description of Artificial Sequence: Synthetic polypeptide
EIVLTQSPGTLSLSPGERATLSCERSSGDIGYSYVSWYQQKPGQAPRLVIYADDQRASGIPDRFSGSGSGTDFTLTISRLEPEDFAVYYCQSYGIIIDIVFGGGTKVEIK

SEQ ID NO: 3512 - protein, 110 aa, Artificial Sequence
  Description of Artificial Sequence: Synthetic polypeptide
EIVLTQSPGTLSLSPGERATLSCERSSGDIYETYVSWYQQKPGQAPRLLIYADDQRPSGIPDRFSGSGSGTDFTLTISRLEPEDFAVYYCQSYDIDIDVVFGGGTKVEIK

SEQ ID NO: 3513 - protein, 110 aa, Artificial Sequence
  Description of Artificial Sequence: Synthetic polypeptide
EIVLTQSPGTLSLSPGERATLSCERSSGDIWEYYVSWYQQKPGQAPRLVIYADDQRASGIPDRFSGSGSGTDFTLTISRLEPEDFAVYYCQSYGLITDVTFGGGTKVEIK

SEQ ID NO: 3514 - protein, 110 aa, Artificial Sequence
  Description of Artificial Sequence: Synthetic polypeptide
EIVLTQSPGTLSLSPGERATLSCERSSGSIWETYVSWYQQKPGQAPRLVIYADDRRPSGIPDRFSGSGSGTDFTLTISRLEPEDFAVYYCQSYGIDIDVVFGGGTKVEIK

SEQ ID NO: 3515 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYADDQRASGIPDRFSGSGSGTDFTLTISRLEPEDFAVYYCQSYGIDTDIVFGGGTKVEIK

SEQ ID NO: 3516 - protein, 110 aa, Artificial Sequence
  Description of Artificial Sequence: Synthetic polypeptide
EIVLTQSPGTLSLSPGERATLSCERSSGDIWDTYVSWYQQKPGQAPRLVIYSDDQRASGIPDRFSGSGSGTDFTLTISRLEPEDFAVYYCQSYGINIDVVFGGGTKVEIK

SEQ ID NO: 3517 - protein, 110 aa, Artificial Sequence
  Description of Artificial Sequence: Synthetic polypeptide
EIVLTQSPGTLSLSPGERATLSCERSSGSIWQTYVSWYQQKPGQAPRLVIYSDDQRASGIPDRFSGSGSGTDFTLTISRLEPEDFAVYYCQSYDIVIDVVFGGGTKVEIK

SEQ ID NO: 3518 - protein, 110 aa, Artificial Sequence
  Description of Artificial Sequence: Synthetic polypeptide
EIVLTQSPGTLSLSPGERATLSCERSSGDIWQYYVSWYQQKPGQAPRLVIYADDHRATGIPDRFSGSGSGTDFTLTISRLEPEDFAVYYCQSYDLDIDVTFGGGTKVEIK

SEQ ID NO: 3519 - protein, 110 aa, Artificial Sequence
  Description of Artificial Sequence: Synthetic polypeptide
EIVLTQSPGTLSLSPGERATLSCERSSGDIWHTYVSWYQQKPGQAPRLVIYADDQRATGIPDRFSGSGSGTDFTLTISRLEPEDFAVYYCQSYDVDIDITFGGGTKVEIK

SEQ ID NO: 3520 - protein, 110 aa, Artificial Sequence
  Description of Artificial Sequence: Synthetic polypeptide
EIVLTQSPGTLSLSPGERATLSCERSSGDIWQAYVSWYQQKPGQAPRLVIYSDDQRPSGIPDRFSGSGSGTDFTLTISRLEPEDFAVYYCQSYDIIEDITFGGGTKVEIK

SEQ ID NO: 3521 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDHRASGIPDRFSGSGSGTDFTLTISRLEPEDFAVYYCQSYGIITDIVFGGGTKVEIK

SEQ ID NO: 3522 - protein, 110 aa, Artificial Sequence
  Description of Artificial Sequence: Synthetic polypeptide
EIVLTQSPGTLSLSPGERATLSCERSSGSIWDYYVSWYQQKPGQAPRLLIYADDQRASGIPDRFSGSGSGTDFTLTISRLEPEDFAVYYCQSYDLITDIVFGGGTKVEIK

SEQ ID NO: 3523 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDQRPSGIPDRFSGSGSGTDFTLTISRLEPEDFAVYYCQSYGINIDVVFGGGTKVEIK

SEQ ID NO: 3524 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYADDQRASGIPDRFSGSGSGTDFTLTISRLEPEDFAVYYCQSYDLIRDIVFGGGTKVEIK

SEQ ID NO: 3525 - protein, 110 aa, Artificial Sequence
  Description of Artificial Sequence: Synthetic polypeptide
EIVLTQSPGTLSLSPGERATLSCERSSGSIYETYVSWYQQKPGQAPRLLIYADDWRASGIPDRFSGSGSGTDFTLTISRLEPEDFAVYYCQSYDITVDVVFGGGTKVEIK

SEQ ID NO: 3526 - protein, 110 aa, Artificial Sequence
  Description of Artificial Sequence: Synthetic polypeptide
EIVLTQSPGTLSLSPGERATLSCERSSGDIWESYVSWYQQKPGQAPRLVIYSDDQRPTGIPDRFSGSGSGTDFTLTISRLEPEDFAVYYCQSYGIIDDIVFGGGTKVEIK

SEQ ID NO: 3527 - protein, 110 aa, Artificial Sequence
  Description of Artificial Sequence: Synthetic polypeptide
EIVLTQSPGTLSLSPGERATLSCERSSGDIWEYYVSWYQQKPGQAPRLLIYADDQRASGIPDRFSGSGSGTDFTLTISRLEPEDFAVYYCQSYDLDIDITFGGGTKVEIK

SEQ ID NO: 3528 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYADDQRASGIPDRFSGSGSGTDFTLTISRLEPEDFAVYYCQSYGIDIDVVFGGGTKVEIK

SEQ ID NO: 3529 - protein, 110 aa, Artificial Sequence
  Description of Artificial Sequence: Synthetic polypeptide
EIVLTQSPGTLSLSPGERATLSCRASSGSIWYSYVSWYQQKPGQAPRLLIYADDQRASGIPDRFSGSGSGTDFTLTISRLEPEDFAVYYCQSYGINIDVVFGGGTKVEIK

SEQ ID NO: 3530 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDHRPSGIPDRFSGSGSGTDFTLTISRLEPEDFAVYYCQSYGIDVDVVFGGGTKVEIK

SEQ ID NO: 3531 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDHRPSGIPDRFSGSGSGTDFTLTISRLEPEDFAVYYCQSYGINVDVVFGGGTKVEIK

SEQ ID NO: 3532 - protein, 110 aa, Artificial Sequence
  Description of Artificial Sequence: Synthetic polypeptide
EIVLTQSPGTLSLSPGERATLSCRASSGDISDKYVSWYQQKPGQAPRLVIYADDYRASGIPDRFSGSGSGTDFTLTISRLEPEDFAVYYCQSYDLCIDVTFGGGTKVEIK

SEQ ID NO: 3533 - protein, 110 aa, Artificial Sequence
  Description of Artificial Sequence: Synthetic polypeptide
EIVLTQSPGTLSLSPGERATLSCRASSGDISDKYVSWYQQKPGQAPRLLIYADDWRASGIPDRFSGSGSGTDFTLTISRLEPEDFAVYYCQSYGIDVDVVFGGGTKVEIK

SEQ ID NO: 3534 - protein, 110 aa, Artificial Sequence
  Description of Artificial Sequence: Synthetic polypeptide
EIVLTQSPGTLSLSPGERATLSCERSSGSIWQYYVSWYQQKPGQAPRLLIYADDQRASGIPDRFSGSGSGTDFTLTISRLEPEDFAVYYCQSYDLDIDVTFGGGTKVEIK

SEQ ID NO: 3535 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYSDDQRASGIPDRFSGSGSGTDFTLTISRLEPEDFAVYYCQSYDLEIDVVFGGGTKVEIK

SEQ ID NO: 3536 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYADDQRPSGIPDRFSGSGSGTDFTLTISRLEPEDFAVYYCQSYDITVDVVFGGGTKVEIK

SEQ ID NO: 3537 - protein, 110 aa, Artificial Sequence
  Description of Artificial Sequence: Synthetic polypeptide
EIVLTQSPGTLSLSPGERATLSCERSSGSIWYSYVSWYQQKPGQAPRLVIYADDQRASGIPDRFSGSGSGTDFTLTISRLEPEDFAVYYCQSYDIDIDVTFGGGTKVEIK

SEQ ID NO: 3538 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRATGIPDRFSGSGSGTDFTLTISRLEPEDFAVYYCQSYDLIIDVTFGGGTKVEIK

SEQ ID NO: 3539 - protein, 110 aa, Artificial Sequence
  Description of Artificial Sequence: Synthetic polypeptide
EIVLTQSPGTLSLSPGERATLSCERSSGDIWETYVSWYQQKPGQAPRLVIYADDQRATGIPDRFSGSGSGTDFTLTISRLEPEDFAVYYCQSYDIDVDIVFGGGTKVEIK

SEQ ID NO: 3540 - protein, 110 aa, Artificial Sequence
  Description of Artificial Sequence: Synthetic polypeptide
EIVLTQSPGTLSLSPGERATLSCERSSGSIWYSYVSWYQQKPGQAPRLVIYSDDQRASGIPDRFSGSGSGTDFTLTISRLEPEDFAVYYCQSYDIDSDIVFGGGTKVEIK

SEQ ID NO: 3541 - protein, 110 aa, Artificial Sequence
  Description of Artificial Sequence: Synthetic polypeptide
EIVLTQSPGTLSLSPGERATLSCRASSGSIWYSFVSWYQQKPGQAPRLVIYADDQRATGIPDRFSGSGSGTDFTLTISRLEPEDFAVYYCQSYGINVDIVFGGGTKVEIK

SEQ ID NO: 3542 - protein, 110 aa, Artificial Sequence
  Description of Artificial Sequence: Synthetic polypeptide
EIVLTQSPGTLSLSPGERATLSCERSSGDIYQTYVSWYQQKPGQAPRLVIYADDQRASGIPDRFSGSGSGTDFTLTISRLEPEDFAVYYCQSYGIDIDVVFGGGTKVEIK

SEQ ID NO: 3543 - protein, 110 aa, Artificial Sequence
  Description of Artificial Sequence: Synthetic polypeptide
EIVLTQSPGTLSLSPGERATLSCERSSGSIWETYVSWYQQKPGQAPRLVIYADDQRASGIPDRFSGSGSGTDFTLTISRLEPEDFAVYYCQSYGVDIDVVFGGGTKVEIK

SEQ ID NO: 3544 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDQRASGIPDRFSGSGSGTDFTLTISRLEPEDFAVYYCQSYDIDIDVVFGGGTKVEIK

SEQ ID NO: 3545 - protein, 110 aa, Artificial Sequence
  Description of Artificial Sequence: Synthetic polypeptide
EIVLTQSPGTLSLSPGERATLSCERSSGSIWQYYVSWYQQKPGQAPRLVIYSDDQRASGIPDRFSGSGSGTDFTLTISRLEPEDFAVYYCQSYDLFIDVTFGGGTKVEIK

SEQ ID NO: 3546 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYSDDQRATGIPDRFSGSGSGTDFTLTISRLEPEDFAVYYCQSYGIYVDIVFGGGTKVEIK

SEQ ID NO: 3547 - protein, 110 aa, Artificial Sequence
  Description of Artificial Sequence: Synthetic polypeptide
EIVLTQSPGTLSLSPGERATLSCERSSGSIYYTYVSWYQQKPGQAPRLVIYADDQRASGIPDRFSGSGSGTDFTLTISRLEPEDFAVYYCQSYDIEIDITFGGGTKVEIK

SEQ ID NO: 3548 - protein, 110 aa, Artificial Sequence
  Description of Artificial Sequence: Synthetic polypeptide
EIVLTQSPGTLSLSPGERATLSCERSSGDIYETYVSWYQQKPGQAPRLVIYSDDHRPSGIPDRFSGSGSGTDFTLTISRLEPEDFAVYYCQSYDIDTDIVFGGGTKVEIK

SEQ ID NO: 3549 - protein, 110 aa, Artificial Sequence
  Description of Artificial Sequence: Synthetic polypeptide
EIVLTQSPGTLSLSPGERATLSCERSSGDIWYSYVSWYQQKPGQAPRLVIYSDDQRASGIPDRFSGSGSGTDFTLTISRLEPEDFAVYYCQSYGINIDVVFGGGTKVEIK

SEQ ID NO: 3550 - protein, 110 aa, Artificial Sequence
  Description of Artificial Sequence: Synthetic polypeptide
EIVLTQSPGTLSLSPGERATLSCERSSGDIWHTYVSWYQQKPGQAPRLLIYADDQRATGIPDRFSGSGSGTDFTLTISRLEPEDFAVYYCQSYGINVDVVFGGGTKVEIK

SEQ ID NO: 3551 - protein, 110 aa, Artificial Sequence
  Description of Artificial Sequence: Synthetic polypeptide
EIVLTQSPGTLSLSPGERATLSCERSSGDIWESYVSWYQQKPGQAPRLLIYSDDQRATGIPDRFSGSGSGTDFTLTISRLEPEDFAVYYCQSYGINIDVVFGGGTKVEIK

SEQ ID NO: 3552 - protein, 110 aa, Artificial Sequence
  Description of Artificial Sequence: Synthetic polypeptide
EIVLTQSPGTLSLSPGERATLSCERSSGDIGHTYVSWYQQKPGQAPRLVIYADDQRASGIPDRFSGSGSGTDFTLTISRLEPEDFAVYYCQSYGIISDVVFGGGTKVEIK

SEQ ID NO: 3553 - protein, 110 aa, Artificial Sequence
  Description of Artificial Sequence: Synthetic polypeptide
EIVLTQSPGTLSLSPGERATLSCERSSGSIWGTYVSWYQQKPGQAPRLVIYADDQRATGIPDRFSGSGSGTDFTLTISRLEPEDFAVYYCQSYDIDIDVTFGGGTKVEIK

SEQ ID NO: 3554 - protein, 110 aa, Artificial Sequence
  Description of Artificial Sequence: Synthetic polypeptide
EIVLTQSPGTLSLPPGERATLSCKRSSGSIYDTYVSWYQQKPGQAPRLVIYSDDQRPSGIPDRFSGSGSGTDFTLTISRLEPEDFAVYYCQSYDLTIDITFGGGTKVEIK

SEQ ID NO: 3555 - protein, 110 aa, Artificial Sequence
  Description of Artificial Sequence: Synthetic polypeptide
EIVLTQSPGTLSLSPGERATLSCERSSGSIWHSYVSWYQQKPGQAPRLLIYSDDQRATGIPDRFSGSGSGTDFTLTISRLEPEDFAVYYCQSYGIYIDVVFGGGTRSKLS

SEQ ID NO: 3556 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYADDQRPSGIPDRFSGSGSGTDFTLTISRLEPEDFAVYYCQSYDLTIDITFGGGTKVEIK

SEQ ID NO: 3557 - protein, 110 aa, Artificial Sequence
  Description of Artificial Sequence: Synthetic polypeptide
EIVLTQSPGTLSLSPGERATPSCRASSGSIWYSFVSWYQQKPGQAPRLLIYADDQRASGIPDRFSGSGSGTDFTLTISRLEPEDFAVYYCQSYGINIDVVFGGGTKVEIK

SEQ ID NO: 3558 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRPSGIPDRFSGSGSGTDFTLTISRLEPEDFAVYYCQPYDLFIDVTFGGGTKVEIK

SEQ ID NO: 3559 - protein, 110 aa, Artificial Sequence
  Description of Artificial Sequence: Synthetic polypeptide
EIVLTQSPGTLSLSPGERATLSCERSSGDIWQSYVSWYQQKPGQAPRLVIYSDDQRASGIPDRFSGSGSGTDFTLTISRLEPEDFAGYYCQSYGINIDVVFGGGTKVEIK

SEQ ID NO: 3560 - protein, 110 aa, Artificial Sequence
  Description of Artificial Sequence: Synthetic polypeptide
EIVLTQSPGTLSLSPGERATLSCERSSGDIGDYYVSWYQQKPGQAPRLVIYADDQRPSGIPDRFSGSGSGTDFTLTISRLEPEDFAVYYCQSYDLFIDVTFGGGTKVEIK

SEQ ID NO: 3561 - protein, 110 aa, Artificial Sequence
  Description of Artificial Sequence: Synthetic polypeptide
EIVLTQSPGTLSLSPGERATLSCERSSGSIWHSYVSWYQQKPGQAPRLLIYSDDQRATGIPDRFSGSGSGTDFTLTISRLEPEDFAVYYCQSYGIETDIVFGGGTKVEIK

SEQ ID NO: 3562 - protein, 110 aa, Artificial Sequence
  Description of Artificial Sequence: Synthetic polypeptide
EIVLTQSPGTWSLSPGERATLSCERSSGSNYDTYVSWYQQKPGQAPRLLIYADDLRASGIPDRFSGSGSGTDFTLTISRLEPEDFAVYYCQSYGIETDIVFGGGTKVEIK

SEQ ID NO: 3563 - protein, 110 aa, Artificial Sequence
  Description of Artificial Sequence: Synthetic polypeptide
EIVLTQSPGTLSLSPGERATLSCERSSGSIWHSYVSWYQQKPGQAPRLLIYSDDQRATGIPDRFSGSGSGTDFTLTISRLEPEDFAVYYCQSYGIYIDVVFGGDTKVEIK

SEQ ID NO: 3564 - protein, 110 aa, Artificial Sequence
  Description of Artificial Sequence: Synthetic polypeptide
EIVLTQSPGTLSLSSGERATLSCERSSGSNYDTYVSWYQQKPGQAPRLLIYADDLRASGIPDRFSGSGSGTDFTLTISRLEPEDFAVYYCQSYGIETDIVFGGGTKVEIK

SEQ ID NO: 3565 - protein, 110 aa, Artificial Sequence
  Description of Artificial Sequence: Synthetic polypeptide
EIVLTQSPGTLSLSPGERATLSCRASSGSTWYSFVSWYQQKPGQAPRLLIYADDQRASGIPDRFSGSGSGTDFTLTISRLEPEDFAVYYCQSYGINIDVVFGGGTKVEIK

SEQ ID NO: 3566 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRPSGIPDRFSGSGSGTDFTLTISRLEPEDFAVYYCQSYDLTIDITFGGGTKVEIK

SEQ ID NO: 3567 - protein, 110 aa, Artificial Sequence
  Description of Artificial Sequence: Synthetic polypeptide
  MOD_RES (99)..(99): Any amino acid
EIVLTQSPGTLSLSPGERATLSCERSSGDIWDYYVSWYQQKPGQAPRLVIYSDDQRPSGIPDRFSGSGSGTDFTLTISRLEPEDFAVYYCQSYDLFIDXTFGGGTKVEIK

SEQ ID NO: 3568 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYADDQRPSGIPDRFSGSGSGTDFTLTISRLEPEGFAVYYCQSYDIIIDIVFGGGTKVEIK

SEQ ID NO: 3569 - protein, 110 aa, Artificial Sequence
  Description of Artificial Sequence: Synthetic polypeptide
EIVLTQSPGTLSLSPGERATLSCERSSGDIWDTYVSWYQQKPGQASRLLIYADDQRPSGIPDRFSGSGSGTDFTLTISRLEPEDFAVYYCQSYDIIIDIVFGGGTKVEIK

SEQ ID NO: 3570 - protein, 110 aa, Artificial Sequence
  Description of Artificial Sequence: Synthetic polypeptide
EIVLTQSPGTLSLSPGERATLSCERSSGSIWHSYVSWYQQKPGQAPRLLIYSDDQRATGIPDRFSGSGSGTDFTLTISRLEPEDFAVYYCQSYGIYIDVVFGGGTNVEIK

SEQ ID NO: 3571 - protein, 110 aa, Artificial Sequence
  Description of Artificial Sequence: Synthetic polypeptide
EIVLTQSPGTLSLSPGERATLSCKRSSGSIYDTYVSWYQQKPGQAPRLVIYSDDQRPSGIPDRFSGSGSGTDFTLTISRLEPEDFAVYYCQSYDLTIDITFGGGTKVEIK

SEQ ID NO: 3572 - protein, 110 aa, Artificial Sequence
  Description of Artificial Sequence: Synthetic polypeptide
EIVLTQSPGTLSLSPGERATLSCERSSGDIWQSYVSWYQQKPGQAPRLVIYSDDQRASGIPDRFSGSGSGTDFTLTISRLEPEDFAVYYCQSYGINIDVVFGGGTKVEIK

SEQ ID NO: 3573 - protein, 110 aa, Artificial Sequence
  Description of Artificial Sequence: Synthetic polypeptide
EIVLTQSPGTLSLSPGERATLSCERSSGSIWHSYVSWYQQKPGQAPRLLIYSDDQRATGIPDRFSGSGSGTDFTLTISRLEPEDFAVYYCQSYGIYIDVVFGGGTKVEIK

SEQ ID NO: 3574 - protein, 110 aa, Artificial Sequence
  Description of Artificial Sequence: Synthetic polypeptide
EIVLTQSPGTLSLSPGERATLSCERSSGDIWDTYVSWYQQKPGQAPRLLIYADDQRPSGIPDRFSGSGSGTDFTLTISRLEPEDFAVYYCQSYDIIIDIVFGGGTKVEIK

SEQ ID NO: 3575 - protein, 110 aa, Artificial Sequence
  Description of Artificial Sequence: Synthetic polypeptide
  MOD_RES (69)..(69): Any amino acid
  MOD_RES (79)..(79): Any amino acid
  MOD_RES (100)..(100): Any amino acid
  MOD_RES (108)..(108): Any amino acid
  MOD_RES (110)..(110): Any amino acid
EIFLTQSPGTLSLSPGKKATLSGKRSSGSIYNTYFSGYQQKPGQAPKRVIYSDDRRPSGIPDRFSGSGXGTDFTLTISXLEPKDFAVYYCQSYDLTINLXFGGGTKVXIX

SEQ ID NO: 3576 - protein, 110 aa, Artificial Sequence
  Description of Artificial Sequence: Synthetic polypeptide
EIVLTQSPGTLSLSPGERATLSCERSSGSNYDTYVSWYQQKPGQAPRLLIYADDLRASGIPDRFSGSGSGTDFTLTISRLEPEDFAVYYCQSYGIETDIVFGGGTKVEIK

SEQ ID NO: 3577 - protein, 110 aa, Artificial Sequence
  Description of Artificial Sequence: Synthetic polypeptide
EIVLTQSPGTLSLSPGERATLSCERSSGDIGDSYVSWYQQKPGQSPRLVIYADDQRPSGIPDRFSGSGSGTDFTLTISRLEPEDFAVYYCQSYDINIDIVFGGGTKVEIK

SEQ ID NO: 3578 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPRGIPDRFSGSGSGTDFTLTISRLEPEDFAVYYCQSYDINIDIVFGGGTKVEIK

SEQ ID NO: 3579 - protein, 110 aa, Artificial Sequence
  Description of Artificial Sequence: Synthetic polypeptide
EIVLTQSPGTLSLSPGERATLSCERSSGSIWQSYVSWYQQKPGQAPRLVIYADDQRATGIPDRFSGSGSGTDFTLTISRLEPEDFAVYYCQSYDIDIDVVFGGGTKVEIS

SEQ ID NO: 3580 - protein, 110 aa, Artificial Sequence
  Description of Artificial Sequence: Synthetic polypeptide
EIVLTQSPGTLSLSPGERATLSCRASSGSIWYSFVSRYQQKPGQAPRLLIYADDQRASGIPDRFSGSGSGTDFTLTISRLEPEDFAVYYCQSYGINIDVVFGGGTKVEIK

SEQ ID NO: 3581 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGIDIDVVFGGGTKVEIK

SEQ ID NO: 3582 - protein, 110 aa, Artificial Sequence
  Description of Artificial Sequence: Synthetic polypeptide
KSSLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIK

SEQ ID NO: 3583 - protein, 110 aa, Artificial Sequence
  Description of Artificial Sequence: Synthetic polypeptide
EIVLTQSLGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIK

SEQ ID NO: 3584 - protein, 110 aa, Artificial Sequence
  Description of Artificial Sequence: Synthetic polypeptide
EIVLTQSPGTLSLSPGERATLSCERSSGDIWQMYVSWYQQKPGQAPRLVIYGDDQRASGIPDRFSGSGSGTDFTLTISRLEPEDFAVYYCQSYDIDIDITFGGGTKVEIK

SEQ ID NO: 3585 - protein, 110 aa, Artificial Sequence
  Description of Artificial Sequence: Synthetic polypeptide
  MOD_RES (110)..(110): Any amino acid
EIVLTQSPGTLSLPPGERATLSCERSSGDIWQTYVSWYQQKPGQAPRLVIYGDDQRASGIPDRFSGSGSGTDFTLTISRLEPEDFAVYYCQSYDIDIDITFGGGHKGRNX

SEQ ID NO: 3586 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRPSGIPDRFSGSGSGTDFTLTISRLEPEDSAVYYCQSYDLFIDVTFGGGTKVEIK

SEQ ID NO: 3587 - protein, 110 aa, Artificial Sequence
  Description of Artificial Sequence: Synthetic polypeptide
EIVLTQSPGTLSLSPGERATLSCERSSGDIWDYYVSWYQRKPGQAPRLVIYADDQRPSGIPDRFSGSGSGTDFTLTISRLEPEDFAVYYCQSYGINIDVVFGGGTKVEIK

SEQ ID NO: 3588 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYGDDQRASGIPDRFSGSGSGTDFTLTISRLEPEDFAVYYCQSYDIDIDITFGGGTKVEIK

SEQ ID NO: 3589 - protein, 110 aa, Artificial Sequence
  Description of Artificial Sequence: Synthetic polypeptide
EIVLTQSPGTLSLSPGERATLSCERSSGSIWQSYVSWYQQKPGQAPRLVIYADDQRATGIPDRFSGSGSGTDFTLTISRLEPEDFAVYYCQSYDIDIDVVFGGGTKVEIK

SEQ ID NO: 3590 - protein, 110 aa, Artificial Sequence
  Description of Artificial Sequence: Synthetic polypeptide
EIVLTQSPGTLSLSPGERATLSCERSSGDIWDYYVSWYQQKPGQAPRLVIYADDQRPSGIPDRFSGSGSGTDFTLTISRLEPEDFAVYYCQSYDLFIDVTFGGGTKVEIK

SEQ ID NO: 3591 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVHYCQSYGINIDVVFGGGTKVEIK

SEQ ID NO: 3592 - protein, 110 aa, Artificial Sequence
  Description of Artificial Sequence: Synthetic polypeptide
EIVLTQSPGTLSLSPGERATLSCERSSGDIWQTYVSWYQQKPGQAPRLVIYGDDQRASGIPDRFSGSGSGTDFTLTISRLEPEDFAVYYCQSYGINIDVVFGGGTKVEIK

SEQ ID NO: 3593 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVCYCQSYGINIDVVFGGGTKVEIK

SEQ ID NO: 3594 - protein, 110 aa, Artificial Sequence
  Description of Artificial Sequence: Synthetic polypeptide
  MOD_RES (110)..(110): Any amino acid
EIVLTQSPGTLSLSPGERAPLSCERSSGDIGDSYVSWYQQKPGQAPRLVIYADDQRPSGIPDRFSGSGSGTDFTLTISRLEPEDFAVYYCQSYDINIDIVFGGGTKVEIX

SEQ ID NO: 3595 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTINRLEPEDFAVYYCQSYDINIDIVFGGGTKVEIK

SEQ ID NO: 3596 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRLSGSGSGTDFTLTISRLEPEDFAVYYCQSYGINIDVVFGGGTKVEIK

SEQ ID NO: 3597 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADGQRPSGIPDRFSGSGSGTDFTLTISRLEPEDFAVYYCQSYDINIDIVFGGGTKVEIK

SEQ ID NO: 3598 - protein, 110 aa, Artificial Sequence
  Description of Artificial Sequence: Synthetic polypeptide
EIVLTQSPSTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3599 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYCQSYGINIDVVFGGGTKVEIN

SEQ ID NO: 3600 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVELS

SEQ ID NO: 3601 - protein, 110 aa, Artificial Sequence
  Description of Artificial Sequence: Synthetic polypeptide
EIVLTQIPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3602 - protein, 110 aa, Artificial Sequence
  Description of Artificial Sequence: Synthetic polypeptide
EIVLTQSPGTLSLSPGERATLSCERSSGSNYDTYVSWYQQKPGQAPRLLIYADDLRASGIPDRFSGSGSGTDFTLTISRLEPEDFAVYYCQSYGINIDVVFGGGTKVEIK

SEQ ID NO: 3603 - protein, 110 aa, Artificial Sequence
  Description of Artificial Sequence: Synthetic polypeptide
EIVLTQSPGTLSLSPGERATLSCRASSGSIWYSFVSWYQQKPGQAPRLLIYADDQRASGIPDRFSGSGSGTDFTLTISRLEPEDFAVYYRQSYGINIDVVFGGGTKVEIK

SEQ ID NO: 3604 - protein, 110 aa, Artificial Sequence; identical to SEQ ID NO: 16
  Description of Artificial Sequence: Synthetic polypeptide

SEQ ID NO: 3605 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPIGIPDRFSGSGSGTDFTLTISRLEPEDFAVYYCQSYDINIDIVFGGGTKVEIK

SEQ ID NO: 3606 - protein, 110 aa, Artificial Sequence
  Description of Artificial Sequence: Synthetic polypeptide
EIVLTQSPGTLSLSPVERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3607 - protein, 110 aa, Artificial Sequence
  Description of Artificial Sequence: Synthetic polypeptide
EIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3608 - protein, 107 aa, Artificial Sequence; identical to SEQ ID NO: 2527
  Description of Artificial Sequence: Synthetic polypeptide

SEQ ID NO: 3609 - protein, 107 aa, Artificial Sequence; identical to SEQ ID NO: 2455
  Description of Artificial Sequence: Synthetic polypeptide

SEQ ID NO: 3610 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSRYDPLTFGQGTKLEIK

SEQ ID NO: 3611 - protein, 107 aa, Artificial Sequence; identical to SEQ ID NO: 2513
  Description of Artificial Sequence: Synthetic polypeptide

SEQ ID NO: 3612 - protein, 107 aa, Artificial Sequence
  Description of Artificial Sequence: Synthetic polypeptide
  MOD_RES (5)..(5): Any amino acid
AKLCXPVPATLSLSPGERATLSCRASQSVSTHMHWYQQKPGQAPRLLIYGASNLESGIPARFSGSGSGTDFTLTISSLEPEDFAVYYCQQSWYDPLTFGQGTKLEIK

SEQ ID NO: 3613 - protein, 107 aa, Artificial Sequence
  Description of Artificial Sequence: Synthetic polypeptide
EIVLTQSPATLSLSPGERATLSCRASQSVSTHMHWYQQKPGQAPRLLIYGASNLESGIPARFSGSGSGTDFTLTISSLEPEDFAVYYCQQSWYDPLTFGQGTKLRSN

SEQ ID NO: 3614 - protein, 122 aa, Artificial Sequence
  Description of Artificial Sequence: Synthetic polypeptide
  MOD_RES (28)..(28): Ser, Ile or Arg
  MOD_RES (30)..(30): Ser, Tyr, Ala, Asp, Thr, Met, Arg, Leu, Cys, Phe, Trp or Pro
  MOD_RES (32)..(32): Tyr or Ser
  MOD_RES (33)..(33): Gly or Glu
  MOD_RES (34)..(34): Met or Val
  MOD_RES (35)..(35): Gly, Ser or Arg
  MOD_RES (36)..(36): Val or Ile
  MOD_RES (37)..(37): Gly, Asp, Leu, Ala, Cys, Val, Tyr, Arg, Thr, Glu or Ser
  MOD_RES (38)..(38): Trp or Leu
  MOD_RES (52)..(52): Asn or Leu
  MOD_RES (54)..(54): Trp, Asp, Cys or Gly
  MOD_RES (55)..(55): Trp or Cys
  MOD_RES (56)..(56): Asp, Tyr, Asn, His, Val, Glu, Ile, Pro, Ala, Cys or Gly
  MOD_RES (57)..(57): Asp, Gly, Asn or His
  MOD_RES (58)..(58): Asp, Glu, Gly, Val, Ala, His, Tyr, Asn, Gln, Ser or Leu
  MOD_RES (59)..(59): Lys, Glu, Thr, Ile, Gln, Val, Asn, Arg, Tyr, Leu, Met or Cys
  MOD_RES (60)..(60): Tyr, His, Cys, Asp, Asn, Ser, Ala, Phe or Gly
  MOD_RES (62)..(62): Asn or Ser
  MOD_RES (63)..(63): Pro, Leu or Thr
  MOD_RES (66)..(66): Lys or Asn
  MOD_RES (67)..(67): Asn, Ser or Thr
  MOD_RES (99)..(99): Arg or Leu
  MOD_RES (100)..(100): Ile, Tyr, Asn, Leu, Met, Val, Arg, Lys, Phe, Cys, Thr or Glu
  MOD_RES (101)..(101): Glu, Gln, Val, Lys, Tyr, Leu, Asp, Gly, Ala, Met, Arg or Ser
  MOD_RES (102)..(102): Ser, Thr, Ala, Tyr, Trp, Pro, Leu, Val, Glu, Lys, Phe or Cys
  MOD_RES (103)..(103): Ile, Gly, Ser, Met, Val, Leu, Phe, Asn, Asp, His, Tyr, Thr, Arg, Gln, Lys, Glu or Pro
  MOD_RES (104)..(104): Gly, Trp, Pro, Phe, Cys, Tyr, Ala, Glu, Leu, Val, Ser, Asp or Arg
  MOD_RES (105)..(105): Thr, Pro, Trp, Arg, Ile, Phe, Ala, Met, Tyr, Ser, Leu, Gly, Asp, Lys, Val, Asn or Glu
  MOD_RES (106)..(106): Thr, Asn, Ser, Lys, Arg, Met, Ala, Glu, Ile, Val, Leu, Trp, Pro or Gln
  MOD_RES (108)..(108): Ser, Glu, Asp, Tyr, Ala, Cys, Asn, Met, Trp, Thr, Gln, Gly, Ile, Leu or Pro
  MOD_RES (110)..(110): Asp or Tyr
EVTLRESGPALVKPTQTLTLTCTFSGFXLXTXXXXXXXIRQPPGKALEWLAXIXXXXXXXYXXSLXXRLTISKDTSKNQVVLTMTNMDPVDTATYYCAXXXXXXXXYXFXYWGQGTMVTVSS

SEQ ID NO: 3615 - protein, 110 aa, Artificial Sequence
  Description of Artificial Sequence: Synthetic polypeptide
  MOD_RES (2)..(2): Ile or Phe
  MOD_RES (24)..(24): Glu, Arg or Lys
  MOD_RES (25)..(25): Arg, Ala, or Glu
  MOD_RES (26)..(26): Ser or Tyr
  MOD_RES (28)..(28): Gly, Cys, Val or Ser
  MOD_RES (29)..(29): Asp, Ser or Tyr
  MOD_RES (30)..(30): Ile, Asn, Thr or Met
  MOD_RES (31)..(31): Gly, Trp, Tyr, Ser, Met, His, Asp, Arg, Glu, Asn, Cys, Ala, Leu, Val, Phe, Thr, Gln or Lys
  MOD_RES (32)..(32): Asp, Tyr, Gln, Asn, His, Gly, Glu, Ser, Lys, Phe, Arg, Leu, Cys, Ala or Pro
  MOD_RES (33)..(33): Ser, Thr, Tyr, Met, Lys, Ala, Cys, Phe, Leu, Glu, Trp, Asp, Pro or Gly
  MOD_RES (34)..(34): Tyr, Phe, Leu, Arg, His, Asn, Cys, Ala, Asp, Ser or Thr
  MOD_RES (35)..(35): Val, Phe or Ser
  MOD_RES (36)..(36): Ser or Pro
  MOD_RES (37)..(37): Trp, Arg or Gly
  MOD_RES (40)..(40): Gln or Arg
  MOD_RES (50)..(50): Ile or Met
  MOD_RES (51)..(51): Tyr or His
  MOD_RES (52)..(52): Ala, Gly, Ser, Trp, Thr, Leu, Val, Phe, Asn, Pro, Glu or Asp
  MOD_RES (53)..(53): Asp, Tyr, Ala or Val
  MOD_RES (54)..(54): Asp or Gly
  MOD_RES (55)..(55): Gln, Leu, Arg, His, Trp, Tyr, Met, Lys, Asp, Ala, Glu, Asn, Val, Ser, Phe or Pro
  MOD_RES (56)..(56): Arg, Gln or Pro
  MOD_RES (57)..(57): Pro or Ala
  MOD_RES (58)..(58): Ser, Ile, Thr, Arg or Gly
  MOD_RES (59)..(59): Gly or Arg
  MOD_RES (90)..(90): Cys or Arg
  MOD_RES (91)..(91): Gln or Lys
  MOD_RES (92)..(92): Ser, Pro, Gln or His
  MOD_RES (94)..(94): Asp or Gly
  MOD_RES (95)..(95): Ile, Leu, Val, Glu, Thr, Ser, Gln, Arg, Asn, Lys, Gly, Ala, Cys or Phe
  MOD_RES (96)..(96): Asn, Phe, Asp, Glu, Thr, Ile, Tyr, Cys, Val, Ser, Arg, Ala, Leu, Gly, His or Lys
  MOD_RES (97)..(97): Ile, Thr, Ser, Val, Asp, Arg, Glu, Met, Leu, Pro, Phe, Asn or Lys
  MOD_RES (98)..(98): Asp, Asn, Pro, Ala, Tyr, Gly, His, Glu, Val, Leu, Gln or Thr
  MOD_RES (99)..(99): Ile, Val, Leu, Gly, Thr, Ser, Asn, Phe, Ala, His, Arg or Gln
  MOD_RES (100)..(100): Val or Thr
EXVLTQSPGTLSLSPGERATLSCXXXSXXXXXXXXXXYQXKPGQAPRLVXXXXXXXXXXIPDRFSGSGSGTDFTLTISRLEPEDFAVYYXXXYXXXXXXXFGGGTKVEIK

SEQ ID NO: 3616 - protein, 122 aa, Artificial Sequence; identical to SEQ ID NO: 3157
  Description of Artificial Sequence: Synthetic polypeptide

SEQ ID NO: 3617 - protein, 12 aa, Artificial Sequence
  Description of Artificial Sequence: Synthetic peptide
GFSLSTYGMGVG

SEQ ID NO: 3618 - protein, 16 aa, Artificial Sequence
  Description of Artificial Sequence: Synthetic peptide
NIWWDDDKYYNPSLKN

SEQ ID NO: 3619 - protein, 12 aa, Artificial Sequence
  Description of Artificial Sequence: Synthetic peptide
IQSGWTNYEFDY

SEQ ID NO: 3620 - protein, 110 aa, Artificial Sequence; identical to SEQ ID NO: 3607
  Description of Artificial Sequence: Synthetic polypeptide

SEQ ID NO: 3621 - protein, 13 aa, Artificial Sequence
  Description of Artificial Sequence: Synthetic peptide
ERSSGDIGDSYVS

SEQ ID NO: 3622 - protein, 7 aa, Artificial Sequence
  Description of Artificial Sequence: Synthetic peptide
ADDQRPS

SEQ ID NO: 3623 - protein, 10 aa, Artificial Sequence
  Description of Artificial Sequence: Synthetic peptide
QSYDINIDIV

SEQ ID NO: 3624 - protein, 122 aa, Artificial Sequence; identical to SEQ ID NO: 3148
  Description of Artificial Sequence: Synthetic polypeptide

SEQ ID NO: 3625 - protein, 12 aa, Artificial Sequence
  Description of Artificial Sequence: Synthetic peptide
GFSLSTYGMGVG

SEQ ID NO: 3626 - protein, 16 aa, Artificial Sequence
  Description of Artificial Sequence: Synthetic peptide
NIWWDDDKYYNPSLKN

SEQ ID NO: 3627 - protein, 12 aa, Artificial Sequence
  Description of Artificial Sequence: Synthetic peptide
IQSMWTRYDFDY

SEQ ID NO: 3628 - protein, 110 aa, Artificial Sequence; identical to SEQ ID NO: 3607
  Description of Artificial Sequence: Synthetic polypeptide

SEQ ID NO: 3629 - protein, 13 aa, Artificial Sequence
  Description of Artificial Sequence: Synthetic peptide
ERSSGDIGDSYVS

SEQ ID NO: 3630 - protein, 7 aa, Artificial Sequence
  Description of Artificial Sequence: Synthetic peptide
ADDQRPS

SEQ ID NO: 3631 - protein, 10 aa, Artificial Sequence
  Description of Artificial Sequence: Synthetic peptide
QSYDINIDIV

SEQ ID NO: 3632 - protein, 122 aa, Artificial Sequence; identical to SEQ ID NO: 15
  Description of Artificial Sequence: Synthetic polypeptide

SEQ ID NO: 3633 - protein, 12 aa, Artificial Sequence
  Description of Artificial Sequence: Synthetic peptide
GFSLSTYGMGVG

SEQ ID NO: 3634 - protein, 16 aa, Artificial Sequence
  Description of Artificial Sequence: Synthetic peptide
NIWWDDDKYYNPSLKN

SEQ ID NO: 3635 - protein, 12 aa, Artificial Sequence
  Description of Artificial Sequence: Synthetic peptide
IESSGPKYSFDY

SEQ ID NO: 3636 - protein, 110 aa, Artificial Sequence; identical to SEQ ID NO: 16
  Description of Artificial Sequence: Synthetic polypeptide

SEQ ID NO: 3637 - protein, 13 aa, Artificial Sequence
  Description of Artificial Sequence: Synthetic peptide
RASSGSIWYSFVS

SEQ ID NO: 3638 - protein, 7 aa, Artificial Sequence
  Description of Artificial Sequence: Synthetic peptide
ADDQRAS

SEQ ID NO: 3639 - protein, 10 aa, Artificial Sequence
  Description of Artificial Sequence: Synthetic peptide
QSYGINIDVV

SEQ ID NO: 3640 - protein, 122 aa, Artificial Sequence; identical to SEQ ID NO: 3154
  Description of Artificial Sequence: Synthetic polypeptide

SEQ ID NO: 3641 - protein, 12 aa, Artificial Sequence
  Description of Artificial Sequence: Synthetic peptide
GFSLSTYGMGVG

SEQ ID NO: 3642 - protein, 16 aa, Artificial Sequence
  Description of Artificial Sequence: Synthetic peptide
NIWWDDDKYYNPSLKN

SEQ ID NO: 3643 - protein, 12 aa, Artificial Sequence
  Description of Artificial Sequence: Synthetic peptide
IESSWTSYSFDY

SEQ ID NO: 3644 - protein, 110 aa, Artificial Sequence; identical to SEQ ID NO: 3602
  Description of Artificial Sequence: Synthetic polypeptide

SEQ ID NO: 3645 - protein, 13 aa, Artificial Sequence
  Description of Artificial Sequence: Synthetic peptide
ERSSGSNYDTYVS

SEQ ID NO: 3646 - protein, 7 aa, Artificial Sequence
  Description of Artificial Sequence: Synthetic peptide
ADDLRAS

SEQ ID NO: 3647 - protein, 10 aa, Artificial Sequence
  Description of Artificial Sequence: Synthetic peptide
QSYGINIDVV

SEQ ID NO: 3648 - protein, 122 aa, Artificial Sequence; identical to SEQ ID NO: 3152
  Description of Artificial Sequence: Synthetic polypeptide

SEQ ID NO: 3649 - protein, 12 aa, Artificial Sequence
  Description of Artificial Sequence: Synthetic peptide
GFSLSTYGMGVG

SEQ ID NO: 3650 - protein, 16 aa, Artificial Sequence
  Description of Artificial Sequence: Synthetic peptide
NIWWDDDKYYNPSLKN

SEQ ID NO: 3651 - protein, 12 aa, Artificial Sequence
  Description of Artificial Sequence: Synthetic peptide
IETIGPKYSFDY

SEQ ID NO: 3652 - protein, 110 aa, Artificial Sequence; identical to SEQ ID NO: 16
  Description of Artificial Sequence: Synthetic polypeptide

SEQ ID NO: 3653 - protein, 13 aa, Artificial Sequence
  Description of Artificial Sequence: Synthetic peptide
RASSGSIWYSFVS

SEQ ID NO: 3654 - protein, 7 aa, Artificial Sequence
  Description of Artificial Sequence: Synthetic peptide
ADDQRAS

SEQ ID NO: 3655 - protein, 10 aa, Artificial Sequence
  Description of Artificial Sequence: Synthetic peptide
QSYGINIDVV

SEQ ID NO: 3656 - protein, 122 aa, Artificial Sequence; identical to SEQ ID NO: 3127
  Description of Artificial Sequence: Synthetic polypeptide

SEQ ID NO: 3657 - protein, 12 aa, Artificial Sequence
  Description of Artificial Sequence: Synthetic peptide
GFSLSTYGMGIG

SEQ ID NO: 3658 - protein, 16 aa, Artificial Sequence
  Description of Artificial Sequence: Synthetic peptide
NIWWDDDKYYNPSLKN

SEQ ID NO: 3659 - protein, 12 aa, Artificial Sequence
  Description of Artificial Sequence: Synthetic peptide
IESMGPKYAFDY

SEQ ID NO: 3660 - protein, 110 aa, Artificial Sequence; identical to SEQ ID NO: 16
  Description of Artificial Sequence: Synthetic polypeptide

SEQ ID NO: 3661 - protein, 13 aa, Artificial Sequence
  Description of Artificial Sequence: Synthetic peptide
RASSGSIWYSFVS

SEQ ID NO: 3662 - protein, 7 aa, Artificial Sequence
  Description of Artificial Sequence: Synthetic peptide
ADDQRAS

SEQ ID NO: 3663 - protein, 10 aa, Artificial Sequence
  Description of Artificial Sequence: Synthetic peptide
QSYGINIDVV

SEQ ID NO: 3664 - protein, 122 aa, Artificial Sequence; identical to SEQ ID NO: 3132
  Description of Artificial Sequence: Synthetic polypeptide

SEQ ID NO: 3665 - protein, 12 aa, Artificial Sequence
  Description of Artificial Sequence: Synthetic peptide
GFSLSTYGMGVG

SEQ ID NO: 3666 - protein, 16 aa, Artificial Sequence
  Description of Artificial Sequence: Synthetic peptide
NIWWDDDKYYNPSLKN

SEQ ID NO: 3667 - protein, 12 aa, Artificial Sequence
  Description of Artificial Sequence: Synthetic peptide
IESLGTSYSFDY

SEQ ID NO: 3668 - protein, 110 aa, Artificial Sequence; identical to SEQ ID NO: 3590
  Description of Artificial Sequence: Synthetic polypeptide

SEQ ID NO: 3669 - protein, 13 aa, Artificial Sequence
  Description of Artificial Sequence: Synthetic peptide
ERSSGDIWDYYVS

SEQ ID NO: 3670 - protein, 7 aa, Artificial Sequence
  Description of Artificial Sequence: Synthetic peptide
ADDQRPS

SEQ ID NO: 3671 - protein, 10 aa, Artificial Sequence
  Description of Artificial Sequence: Synthetic peptide
QSYDLFIDVT

SEQ ID NO: 3672 - protein, 122 aa, Artificial Sequence; identical to SEQ ID NO: 3135
  Description of Artificial Sequence: Synthetic polypeptide

SEQ ID NO: 3673 - protein, 12 aa, Artificial Sequence
  Description of Artificial Sequence: Synthetic peptide
GFSLSTYGMGVG

SEQ ID NO: 3674 - protein, 16 aa, Artificial Sequence
  Description of Artificial Sequence: Synthetic peptide
NIWWDDDKYYNPSLKN

SEQ ID NO: 3675 - protein, 12 aa, Artificial Sequence
  Description of Artificial Sequence: Synthetic peptide
IETMGPKYSFDY

SEQ ID NO: 3676 - protein, 110 aa, Artificial Sequence; identical to SEQ ID NO: 16
  Description of Artificial Sequence: Synthetic polypeptide

SEQ ID NO: 3677 - protein, 13 aa, Artificial Sequence
  Description of Artificial Sequence: Synthetic peptide
RASSGSIWYSFVS

SEQ ID NO: 3678 - protein, 7 aa, Artificial Sequence
  Description of Artificial Sequence: Synthetic peptide
ADDQRAS

SEQ ID NO: 3679 - protein, 10 aa, Artificial Sequence
  Description of Artificial Sequence: Synthetic peptide
QSYGINIDVV

SEQ ID NO: 3680 - protein, 122 aa, Artificial Sequence; identical to SEQ ID NO: 3140
  Description of Artificial Sequence: Synthetic polypeptide

SEQ ID NO: 3681 - protein, 12 aa, Artificial Sequence
  Description of Artificial Sequence: Synthetic peptide
GFSLSTYGMGVG

SEQ ID NO: 3682 - protein, 16 aa, Artificial Sequence
  Description of Artificial Sequence: Synthetic peptide
NIWWDDDKYYNPSLKN

SEQ ID NO: 3683 - protein, 12 aa, Artificial Sequence
  Description of Artificial Sequence: Synthetic peptide
IESIPTSYSFDY

SEQ ID NO: 3684 - protein, 110 aa, Artificial Sequence; identical to SEQ ID NO: 3589
  Description of Artificial Sequence: Synthetic polypeptide

SEQ ID NO: 3685 - protein, 13 aa, Artificial Sequence
  Description of Artificial Sequence: Synthetic peptide
ERSSGSIWQSYVS

SEQ ID NO: 3686 - protein, 7 aa, Artificial Sequence
  Description of Artificial Sequence: Synthetic peptide
ADDQRAT

SEQ ID NO: 3687 - protein, 10 aa, Artificial Sequence
  Description of Artificial Sequence: Synthetic peptide
QSYDIDIDVV

SEQ ID NO: 3688 - protein, 122 aa, Artificial Sequence; identical to SEQ ID NO: 3138
  Description of Artificial Sequence: Synthetic polypeptide

SEQ ID NO: 3689 - protein, 12 aa, Artificial Sequence
  Description of Artificial Sequence: Synthetic peptide
GFSLSTYGMGVG

SEQ ID NO: 3690 - protein, 16 aa, Artificial Sequence
  Description of Artificial Sequence: Synthetic peptide
NIWWDDDKYYNPSLKN

SEQ ID NO: 3691 - protein, 12 aa, Artificial Sequence
  Description of Artificial Sequence: Synthetic peptide
IESSGPKYSFDY

SEQ ID NO: 3692 - protein, 110 aa, Artificial Sequence; identical to SEQ ID NO: 16
  Description of Artificial Sequence: Synthetic polypeptide

SEQ ID NO: 3693 - protein, 13 aa, Artificial Sequence
  Description of Artificial Sequence: Synthetic peptide
RASSGSIWYSFVS

SEQ ID NO: 3694 - protein, 7 aa, Artificial Sequence
  Description of Artificial Sequence: Synthetic peptide
ADDQRAS

SEQ ID NO: 3695 - protein, 10 aa, Artificial Sequence
  Description of Artificial Sequence: Synthetic peptide
QSYGINIDVV

SEQ ID NO: 3696 - protein, 122 aa, Artificial Sequence; identical to SEQ ID NO: 3134
  Description of Artificial Sequence: Synthetic polypeptide

SEQ ID NO: 3697 - protein, 12 aa, Artificial Sequence
  Description of Artificial Sequence: Synthetic peptide
GFSLSTYGMGVG

SEQ ID NO: 3698 - protein, 16 aa, Artificial Sequence
  Description of Artificial Sequence: Synthetic peptide
NIWWDDDKYYNPSLKN

SEQ ID NO: 3699 - protein, 12 aa, Artificial Sequence
  Description of Artificial Sequence: Synthetic peptide
IESVWTRYDFDY

SEQ ID NO: 3700 - protein, 110 aa, Artificial Sequence; identical to SEQ ID NO: 3588
  Description of Artificial Sequence: Synthetic polypeptide

SEQ ID NO: 3701 - protein, 13 aa, Artificial Sequence
  Description of Artificial Sequence: Synthetic peptide
ERSSGDIWQTYVS

SEQ ID NO: 3702 - protein, 7 aa, Artificial Sequence
  Description of Artificial Sequence: Synthetic peptide
GDDQRAS

SEQ ID NO: 3703 - protein, 10 aa, Artificial Sequence
  Description of Artificial Sequence: Synthetic peptide
QSYDIDIDIT

SEQ ID NO: 3704 - protein, 122 aa, Artificial Sequence; identical to SEQ ID NO: 3133
  Description of Artificial Sequence: Synthetic polypeptide

SEQ ID NO: 3705 - protein, 12 aa, Artificial Sequence
  Description of Artificial Sequence: Synthetic peptide
GFSLSTYGMGVG

SEQ ID NO: 3706 - protein, 16 aa, Artificial Sequence
  Description of Artificial Sequence: Synthetic peptide
NIWWDDDKYYNPSLKN

SEQ ID NO: 3707 - protein, 12 aa, Artificial Sequence
  Description of Artificial Sequence: Synthetic peptide
IESIGPKYSFDY

SEQ ID NO: 3708 - protein, 110 aa, Artificial Sequence; identical to SEQ ID NO: 16
  Description of Artificial Sequence: Synthetic polypeptide

SEQ ID NO: 3709 - protein, 13 aa, Artificial Sequence
  Description of Artificial Sequence: Synthetic peptide
RASSGSIWYSFVS

SEQ ID NO: 3710 - protein, 7 aa, Artificial Sequence
  Description of Artificial Sequence: Synthetic peptide
ADDQRAS

SEQ ID NO: 3711 - protein, 10 aa, Artificial Sequence
  Description of Artificial Sequence: Synthetic peptide
QSYGINIDVV

SEQ ID NO: 3712 - protein, 122 aa, Artificial Sequence; identical to SEQ ID NO: 3133
  Description of Artificial Sequence: Synthetic polypeptide

SEQ ID NO: 3713 - protein, 12 aa, Artificial Sequence
  Description of Artificial Sequence: Synthetic peptide
GFSLSTYGMGVG

SEQ ID NO: 3714 - protein, 16 aa, Artificial Sequence
  Description of Artificial Sequence: Synthetic peptide
NIWWDDDKYYNPSLKN

SEQ ID NO: 3715 - protein, 12 aa, Artificial Sequence
  Description of Artificial Sequence: Synthetic peptide
IESIGPKYSFDY

SEQ ID NO: 3716 - protein, 110 aa, Artificial Sequence; identical to SEQ ID NO: 16
  Description of Artificial Sequence: Synthetic polypeptide

SEQ ID NO: 3717 - protein, 13 aa, Artificial Sequence
  Description of Artificial Sequence: Synthetic peptide
RASSGSIWYSFVS

SEQ ID NO: 3718 - protein, 7 aa, Artificial Sequence
  Description of Artificial Sequence: Synthetic peptide
ADDQRAS

SEQ ID NO: 3719 - protein, 10 aa, Artificial Sequence
  Description of Artificial Sequence: Synthetic peptide
QSYGINIDVV

SEQ ID NO: 3720 - protein, 122 aa, Artificial Sequence; identical to SEQ ID NO: 3122
  Description of Artificial Sequence: Synthetic polypeptide

SEQ ID NO: 3721 - protein, 12 aa, Artificial Sequence
  Description of Artificial Sequence: Synthetic peptide
GFSLSTYGMGVG

SEQ ID NO: 3722 - protein, 16 aa, Artificial Sequence
  Description of Artificial Sequence: Synthetic peptide
NIWWDDDKYYNPSLKN

SEQ ID NO: 3723 - protein, 12 aa, Artificial Sequence
  Description of Artificial Sequence: Synthetic peptide
IESLGWSYSFDY

SEQ ID NO: 3724 - protein, 110 aa, Artificial Sequence; identical to SEQ ID NO: 3590
  Description of Artificial Sequence: Synthetic polypeptide

SEQ ID NO: 3725 - protein, 13 aa, Artificial Sequence
  Description of Artificial Sequence: Synthetic peptide
ERSSGDIWDYYVS

SEQ ID NO: 3726 - protein, 7 aa, Artificial Sequence
  Description of Artificial Sequence: Synthetic peptide
ADDQRPS

SEQ ID NO: 3727 - protein, 10 aa, Artificial Sequence
  Description of Artificial Sequence: Synthetic peptide
QSYDLFIDVT

SEQ ID NO: 3728 - protein, 122 aa, Artificial Sequence; identical to SEQ ID NO: 3123
  Description of Artificial Sequence: Synthetic polypeptide

SEQ ID NO: 3729 - protein, 12 aa, Artificial Sequence
  Description of Artificial Sequence: Synthetic peptide
GFSLSTYGMGVG

SEQ ID NO: 3730 - protein, 16 aa, Artificial Sequence
  Description of Artificial Sequence: Synthetic peptide
NIWWDDDKYYNPSLKN

SEQ ID NO: 3731 - protein, 12 aa, Artificial Sequence
  Description of Artificial Sequence: Synthetic peptide
IESLPTSYSFDY

SEQ ID NO: 3732 - protein, 110 aa, Artificial Sequence; identical to SEQ ID NO: 3574
  Description of Artificial Sequence: Synthetic polypeptide

SEQ ID NO: 3733 - protein, 13 aa, Artificial Sequence
  Description of Artificial Sequence: Synthetic peptide
ERSSGDIWDTYVS

SEQ ID NO: 3734 - protein, 7 aa, Artificial Sequence
  Description of Artificial Sequence: Synthetic peptide
ADDQRPS

SEQ ID NO: 3735 - protein, 10 aa, Artificial Sequence
  Description of Artificial Sequence: Synthetic peptide
QSYDIIIDIV

SEQ ID NO: 3736 - protein, 122 aa, Artificial Sequence; identical to SEQ ID NO: 3113
  Description of Artificial Sequence: Synthetic polypeptide

SEQ ID NO: 3737 - protein, 12 aa, Artificial Sequence
  Description of Artificial Sequence: Synthetic peptide
GFSLSTYGMGVG

SEQ ID NO: 3738 - protein, 16 aa, Artificial Sequence
  Description of Artificial Sequence: Synthetic peptide
NIWWDDDKYYNPSLKN

SEQ ID NO: 3739 - protein, 12 aa, Artificial Sequence
  Description of Artificial Sequence: Synthetic peptide
IESHWWSYAFDY

SEQ ID NO: 3740 - protein, 110 aa, Artificial Sequence; identical to SEQ ID NO: 3576
  Description of Artificial Sequence: Synthetic polypeptide

SEQ ID NO: 3741 - protein, 13 aa, Artificial Sequence
  Description of Artificial Sequence: Synthetic peptide
ERSSGSNYDTYVS

SEQ ID NO: 3742 - protein, 7 aa, Artificial Sequence
  Description of Artificial Sequence: Synthetic peptide
ADDLRAS

SEQ ID NO: 3743 - protein, 10 aa, Artificial Sequence
  Description of Artificial Sequence: Synthetic peptide
QSYGIETDIV

SEQ ID NO: 3744 - protein, 122 aa, Artificial Sequence; identical to SEQ ID NO: 3124
  Description of Artificial Sequence: Synthetic polypeptide

SEQ ID NO: 3745 - protein, 12 aa, Artificial Sequence
  Description of Artificial Sequence: Synthetic peptide
GFSLSTYGMGVG

SEQ ID NO: 3746 - protein, 16 aa, Artificial Sequence
  Description of Artificial Sequence: Synthetic peptide
NIWWDDDKYYNPSLKN

SEQ ID NO: 3747 - protein, 12 aa, Artificial Sequence
  Description of Artificial Sequence: Synthetic peptide
IESSWTTYSFDY

SEQ ID NO: 3748 - protein, 110 aa, Artificial Sequence; identical to SEQ ID NO: 3573
  Description of Artificial Sequence: Synthetic polypeptide

SEQ ID NO: 3749 - protein, 13 aa, Artificial Sequence
  Description of Artificial Sequence: Synthetic peptide
ERSSGSIWHSYVS

SEQ ID NO: 3750 - protein, 7 aa, Artificial Sequence
  Description of Artificial Sequence: Synthetic peptide
SDDQRAT

SEQ ID NO: 3751 - protein, 10 aa, Artificial Sequence
  Description of Artificial Sequence: Synthetic peptide
QSYGIYIDVV

SEQ ID NO: 3752 - protein, 122 aa, Artificial Sequence; identical to SEQ ID NO: 3125
  Description of Artificial Sequence: Synthetic polypeptide

SEQ ID NO: 3753 - protein, 12 aa, Artificial Sequence
  Description of Artificial Sequence: Synthetic peptide
GFSLSTYGMGVG

SEQ ID NO: 3754 - protein, 16 aa, Artificial Sequence
  Description of Artificial Sequence: Synthetic peptide
NIWWDDDKYYNPSLKN

SEQ ID NO: 3755 - protein, 12 aa, Artificial Sequence
  Description of Artificial Sequence: Synthetic peptide
IESNPWKYSFDY

SEQ ID NO: 3756 - protein, 110 aa, Artificial Sequence; identical to SEQ ID NO: 3572
  Description of Artificial Sequence: Synthetic polypeptide

SEQ ID NO: 3757 - protein, 13 aa, Artificial Sequence
  Description of Artificial Sequence: Synthetic peptide
ERSSGDIWQSYVS

SEQ ID NO: 3758 - protein, 7 aa, Artificial Sequence
  Description of Artificial Sequence: Synthetic peptide
SDDQRAS

SEQ ID NO: 3759 - protein, 10 aa, Artificial Sequence
  Description of Artificial Sequence: Synthetic peptide
QSYGINIDVV

SEQ ID NO: 3760 - protein, 122 aa, Artificial Sequence; identical to SEQ ID NO: 3119
  Description of Artificial Sequence: Synthetic polypeptide

SEQ ID NO: 3761 - protein, 12 aa, Artificial Sequence
  Description of Artificial Sequence: Synthetic peptide
GFSLSTYGMGVG

SEQ ID NO: 3762 - protein, 16 aa, Artificial Sequence
  Description of Artificial Sequence: Synthetic peptide
NIWWDDDKYYNPSLKN

SEQ ID NO: 3763 - protein, 12 aa, Artificial Sequence
  Description of Artificial Sequence: Synthetic peptide
IESSFTSYSFDY

SEQ ID NO: 3764 - protein, 110 aa, Artificial Sequence; identical to SEQ ID NO: 3571
  Description of Artificial Sequence: Synthetic polypeptide

SEQ ID NO: 3765 - protein, 13 aa, Artificial Sequence
  Description of Artificial Sequence: Synthetic peptide
KRSSGSIYDTYVS

SEQ ID NO: 3766 - protein, 7 aa, Artificial Sequence
  Description of Artificial Sequence: Synthetic peptide
SDDQRPS

SEQ ID NO: 3767 - protein, 10 aa, Artificial Sequence
  Description of Artificial Sequence: Synthetic peptide
QSYDLTIDIT

SEQ ID NO: 3768 - protein, 122 aa, Artificial Sequence; identical to SEQ ID NO: 3121
  Description of Artificial Sequence: Synthetic polypeptide

SEQ ID NO: 3769 - protein, 12 aa, Artificial Sequence
  Description of Artificial Sequence: Synthetic peptide
GFSLSTYGMGVG

SEQ ID NO: 3770 - protein, 16 aa, Artificial Sequence
  Description of Artificial Sequence: Synthetic peptide
NIWWDDDKYYNPSLKN

SEQ ID NO: 3771 - protein, 12 aa, Artificial Sequence
  Description of Artificial Sequence: Synthetic peptide
IVSDWTTYSFDY

SEQ ID NO: 3772 - protein, 110 aa, Artificial Sequence; identical to SEQ ID NO: 16
  Description of Artificial Sequence: Synthetic polypeptide

SEQ ID NO: 3773 - protein, 13 aa, Artificial Sequence
  Description of Artificial Sequence: Synthetic peptide
RASSGSIWYSFVS

SEQ ID NO: 3774 - protein, 7 aa, Artificial Sequence
  Description of Artificial Sequence: Synthetic peptide
ADDQRAS

SEQ ID NO: 3775 - protein, 10 aa, Artificial Sequence
  Description of Artificial Sequence: Synthetic peptide
QSYGINIDVV

SEQ ID NO: 3776 - protein, 122 aa, Artificial Sequence; identical to SEQ ID NO: 3126
  Description of Artificial Sequence: Synthetic polypeptide

SEQ ID NO: 3777 - protein, 12 aa, Artificial Sequence
  Description of Artificial Sequence: Synthetic peptide
GFSLSTYGMGVG

SEQ ID NO: 3778 - protein, 16 aa, Artificial Sequence
  Description of Artificial Sequence: Synthetic peptide
NIWWDDDKYYNPSLKN

SEQ ID NO: 3779 - protein, 12 aa, Artificial Sequence
  Description of Artificial Sequence: Synthetic peptide
IETFGPKYSFDY

SEQ ID NO: 3780 - protein, 110 aa, Artificial Sequence; identical to SEQ ID NO: 16
  Description of Artificial Sequence: Synthetic polypeptide

SEQ ID NO: 3781 - protein, 13 aa, Artificial Sequence
  Description of Artificial Sequence: Synthetic peptide
RASSGSIWYSFVS

SEQ ID NO: 3782 - protein, 7 aa, Artificial Sequence
  Description of Artificial Sequence: Synthetic peptide
ADDQRAS

SEQ ID NO: 3783 - protein, 10 aa, Artificial Sequence
  Description of Artificial Sequence: Synthetic peptide
QSYGINIDVV

SEQ ID NO: 3784 - protein, 6 aa, Artificial Sequence
  Description of Artificial Sequence: Synthetic peptide
ASTKGP

SEQ ID NO: 3785 - protein, 13 aa, Artificial Sequence
  Description of Artificial Sequence: Synthetic peptide
ASTKGPSVFPLAP

SEQ ID NO: 3786 - protein, 10 aa, Artificial Sequence
  Description of Artificial Sequence: Synthetic peptide
GGGGSGGGGS

SEQ ID NO: 3787 - protein, 6 aa, Artificial Sequence
  Description of Artificial Sequence: Synthetic peptide
RTVAAP

SEQ ID NO: 3788 - protein, 13 aa, Artificial Sequence
  Description of Artificial Sequence: Synthetic peptide
RTVAAPSVFIFPP

SEQ ID NO: 3789 - protein, 10 aa, Artificial Sequence
  Description of Artificial Sequence: Synthetic peptide
RGGSGGGGSG

SEQ ID NO: 3790 - protein, 10 aa, Artificial Sequence
  Description of Artificial Sequence: Synthetic peptide
GGSGGGGSGG

SEQ ID NO: 3791 - protein, 11 aa, Artificial Sequence
  Description of Artificial Sequence: Synthetic peptide
RGGSGGGGSGG

SEQ ID NO: 3792 - protein, 16 aa, Artificial Sequence
  Description of Artificial Sequence: Synthetic peptide
AKTTPKLEEGEFSEAR

SEQ ID NO: 3793 - protein, 17 aa, Artificial Sequence
  Description of Artificial Sequence: Synthetic peptide
AKTTPKLEEGEFSEARV

SEQ ID NO: 3794 - protein, 9 aa, Artificial Sequence
  Description of Artificial Sequence: Synthetic peptide
AKTTPKLGG

SEQ ID NO: 3795 - protein, 10 aa, Artificial Sequence
  Description of Artificial Sequence: Synthetic peptide
SAKTTPKLGG

SEQ ID NO: 3796 - protein, 6 aa, Artificial Sequence
  Description of Artificial Sequence: Synthetic peptide
SAKTTP

SEQ ID NO: 3797 - protein, 6 aa, Artificial Sequence
  Description of Artificial Sequence: Synthetic peptide
RADAAP

SEQ ID NO: 3798 - protein, 9 aa, Artificial Sequence
  Description of Artificial Sequence: Synthetic peptide
RADAAPTVS

SEQ ID NO: 3799 - protein, 12 aa, Artificial Sequence
  Description of Artificial Sequence: Synthetic peptide
RADAAAAGGPGS

SEQ ID NO: 3800 - protein, 27 aa, Artificial Sequence
  Description of Artificial Sequence: Synthetic peptide
RADAAAAGGGGSGGGGSGGGGSGGGGS

SEQ ID NO: 3801 - protein, 18 aa, Artificial Sequence
  Description of Artificial Sequence: Synthetic peptide
SAKTTPKLEEGEFSEARV

SEQ ID NO: 3802 - protein, 5 aa, Artificial Sequence
  Description of Artificial Sequence: Synthetic peptide
ADAAP

SEQ ID NO: 3803 - protein, 12 aa, Artificial Sequence
  Description of Artificial Sequence: Synthetic peptide
ADAAPTVSIFPP

SEQ ID NO: 3804 - protein, 5 aa, Artificial Sequence
  Description of Artificial Sequence: Synthetic peptide
TVAAP

SEQ ID NO: 3805 - protein, 12 aa, Artificial Sequence
  Description of Artificial Sequence: Synthetic peptide
TVAAPSVFIFPP

SEQ ID NO: 3806 - protein, 6 aa, Artificial Sequence
  Description of Artificial Sequence: Synthetic peptide
QPKAAP

SEQ ID NO: 3807 - protein, 13 aa, Artificial Sequence
  Description of Artificial Sequence: Synthetic peptide
QPKAAPSVTLFPP

SEQ ID NO: 3808 - protein, 6 aa, Artificial Sequence
  Description of Artificial Sequence: Synthetic peptide
AKTTPP

SEQ ID NO: 3809 - protein, 13 aa, Artificial Sequence
  Description of Artificial Sequence: Synthetic peptide
AKTTPPSVTPLAP

SEQ ID NO: 3810 - protein, 6 aa, Artificial Sequence
  Description of Artificial Sequence: Synthetic peptide
AKTTAP

SEQ ID NO: 3811 - protein, 13 aa, Artificial Sequence
  Description of Artificial Sequence: Synthetic peptide
AKTTAPSVYPLAP

SEQ ID NO: 3812 - protein, 6 aa, Artificial Sequence
  Description of Artificial Sequence: Synthetic peptide
ASTKGP

SEQ ID NO: 3813 - protein, 13 aa, Artificial Sequence
  Description of Artificial Sequence: Synthetic peptide
ASTKGPSVFPLAP

SEQ ID NO: 3814 - protein, 15 aa, Artificial Sequence
  Description of Artificial Sequence: Synthetic peptide
GGGGSGGGGSGGGGS

SEQ ID NO: 3815 - protein, 15 aa, Artificial Sequence
  Description of Artificial Sequence: Synthetic peptide
GENKVEYAPALMALS

SEQ ID NO: 3816 - protein, 15 aa, Artificial Sequence
  Description of Artificial Sequence: Synthetic peptide
GPAKELTPLKEAKVS

SEQ ID NO: 3817 - protein, 15 aa, Artificial Sequence
  Description of Artificial Sequence: Synthetic peptide
GHEAAAVMQVQYPAS

SEQ ID NO: 3818 - protein, 24 aa, Artificial Sequence
  Description of Artificial Sequence: Synthetic peptide
TVAAPSVFIFPPTVAAPSVFIFPP

SEQ ID NO: 3819 - protein, 26 aa, Artificial Sequence
  Description of Artificial Sequence: Synthetic peptide
ASTKGPSVFPLAPASTKGPSVFPLAP

SEQ ID NO: 3820 - protein, 10 aa, Artificial Sequence
  Description of Artificial Sequence: Synthetic peptide
GGGGSGGGGS

SEQ ID NO: 3821 - protein, 9 aa, Artificial Sequence
  Description of Artificial Sequence: Synthetic peptide
GGSGGGGSG

SEQ ID NO: 3822 - protein, 5 aa, Artificial Sequence
  Description of Artificial Sequence: Synthetic peptide
GGGGS

SEQ ID NO: 3823 - protein, 585 aa, Artificial Sequence; identical to SEQ ID NO: 84
  Description of Artificial Sequence: Synthetic polypeptide

SEQ ID NO: 3824 - protein, 334 aa, Artificial Sequence; identical to SEQ ID NO: 54
  Description of Artificial Sequence: Synthetic polypeptide

SEQ ID NO: 3825 - protein, 581 aa, Artificial Sequence; identical to SEQ ID NO: 86
  Description of Artificial Sequence: Synthetic polypeptide

SEQ ID NO: 3826 - protein, 337 aa, Artificial Sequence; identical to SEQ ID NO: 58
  Description of Artificial Sequence: Synthetic polypeptide

SEQ ID NO: 3827 - protein, 588 aa, Artificial Sequence; identical to SEQ ID NO: 96
  Description of Artificial Sequence: Synthetic polypeptide

SEQ ID NO: 3828 - protein, 330 aa, Artificial Sequence; identical to SEQ ID NO: 56
  Description of Artificial Sequence: Synthetic polypeptide

SEQ ID NO: 3829 - protein, 585 aa, Artificial Sequence; identical to SEQ ID NO: 84
  Description of Artificial Sequence: Synthetic polypeptide

SEQ ID NO: 3830 - protein, 334 aa, Artificial Sequence; identical to SEQ ID NO: 89
  Description of Artificial Sequence: Synthetic polypeptide

SEQ ID NO: 3831 - protein, 581 aa, Artificial Sequence; identical to SEQ ID NO: 86
  Description of Artificial Sequence: Synthetic polypeptide

SEQ ID NO: 3832 - protein, 337 aa, Artificial Sequence; identical to SEQ ID NO: 95
  Description of Artificial Sequence: Synthetic polypeptide

SEQ ID NO: 3833 - protein, 586 aa, Artificial Sequence; identical to SEQ ID NO: 131
  Description of Artificial Sequence: Synthetic polypeptide

SEQ ID NO: 3834 - protein, 334 aa, Artificial Sequence; identical to SEQ ID NO: 132
  Description of Artificial Sequence: Synthetic polypeptide

SEQ ID NO: 3835 - protein, 578 aa, Artificial Sequence; identical to SEQ ID NO: 141
  Description of Artificial Sequence: Synthetic polypeptide

SEQ ID NO: 3836 - protein, 334 aa, Artificial Sequence; identical to SEQ ID NO: 142
  Description of Artificial Sequence: Synthetic polypeptide

SEQ ID NO: 3837 - protein, 579 aa, Artificial Sequence
  Description of Artificial Sequence: Synthetic polypeptide
EVTLKESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSGEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3838 - protein, 336 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKGGGSGGGDFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3839 - protein, 706 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGKGGSGGGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSGGGGSEIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3840 - protein, 710 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGKGGSGGGGSGGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSGGGGSEIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3841 - protein, 715 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGKGGSGGGGSGGGGSGGEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSSGGGGSGGGGSGGGGSEIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIK

SEQ ID NO: 3842 - protein, 710 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNAYTQKSLSLSPGKGGSGGGGSGGEIVLTQSPGTLSLSPGERATLSCERSSGDIGDSYVSWYQQKPGQAPRLVIYADDQRPSGIPDRFSGSGSGTDFTLTISRLEPEDFAVYYCQSYDINIDIVFGGGTKVEIKGGGGSGGGGSGGGGSEVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 3843 - protein, 214 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3844 - protein, 579 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGEVTLKESGPALVKPTQTLTLTCTFSGFSLSTFGMGVGWIRQPPGKALEWLANIWWDDDKYYNPSLKNRLTISKDTSKNQAVLTITNMDPVDTATYYCARISTGISSYYVMDAWGQGTTVTVSSGGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3845 - protein, 336 aa, Artificial Sequence
  Description of Artificial Sequence: Synthetic polypeptide
DFQLTQSPSSLSASVGDRVTITCERSSGDIGDTYVSWYQQKPGKAPKNVIYGNDQRPSGVPSRFSGSGSGNSATLTISSLQPEDFATYFCQSYDSDIDIVFGQGTKVEIKGGGSGGGDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKGGGSGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3846 - protein, 10 aa, Artificial Sequence
  Description of Artificial Sequence: Synthetic peptide
  MOD_RES (5)..(5): Thr, Gln, Asp, Glu, Asn, Ala, Gly, His, Lys, Met, Leu, Arg, Ile, Tyr or Val
  MOD_RES (6)..(6): Asn, Ser, Lys, Tyr, Thr, Met, Gly, Ala, Ile, Leu, Glu, Pro, Gln or Phe
  MOD_RES (8)..(8): Gly, Ser, Asp, Lys, Cys, Val, Glu, Leu, Trp, Pro, Tyr, Met, Asn or Thr
GYTFXXYXMY

SEQ ID NO: 3847 - protein, 17 aa, Artificial Sequence
  Description of Artificial Sequence: Synthetic peptide
  MOD_RES (5)..(5): Glu, Tyr, Leu, Val, Trp, Ala, Gln, His, Gly, Lys, Asn, Met, Thr or Pro
  MOD_RES (8)..(8): Lys, Asn, Asp, Thr, Pro, Trp, Tyr, Val, Ser, Met, Ala, Ile, Gly, Arg or Leu
  MOD_RES (10)..(10): Thr, Ile, Met, Lys, Ala, Asn, Pro, Leu, Val, Trp, Asp, Tyr, Gly or Glu
  MOD_RES (13)..(13): Asp, Tyr or His
  MOD_RES (16)..(16): Lys or Asn
WINTXTGXPXYAXDFXG

SEQ ID NO: 3848 - protein, 14 aa, Artificial Sequence
  Description of Artificial Sequence: Synthetic peptide
  MOD_RES (1)..(1): Thr, Tyr, Gly, Ile, Ser, Lys, Asn, Pro, Leu, Trp, Met, Phe, Arg or Gln
  MOD_RES (2)..(2): Asn, His, Ile, Thr, Asp, Phe, Leu, Glu, Val, Tyr, Ala, Gly, Trp, Gln or Arg
  MOD_RES (6)..(6): Arg, Ser, Asn, Glu, Met, Leu, Thr, Trp, Gln, Gly, Ile, Ala, Cys or Val
  MOD_RES (7)..(7): Any amino acid
  MOD_RES (9)..(9): Ile, Leu, Asn, Thr, Val, Ala, Arg, Phe, Asp or Ser
XXYYYXXYXFYFDY

SEQ ID NO: 3849 - protein, 11 aa, Artificial Sequence
  Description of Artificial Sequence: Synthetic peptide
  MOD_RES (7)..(7): Ser, Asn, Asp, Thr, Arg, His, Glu, Ile, Leu, Gln, Cys, Met, Tyr, Lys or Val
  MOD_RES (8)..(8): Thr, Ser, Arg, Ala, Glu, Asp, Met, Pro, Tyr, Ile, Trp or Phe
  MOD_RES (9)..(9): His, Ala, Asp, Cys, Pro, Arg, Tyr, Leu, Gln or Lys
  MOD_RES (11)..(11): His, Ala or Pro
RASESVXXXMX

SEQ ID NO: 3850 - protein, 7 aa, Artificial Sequence
  Description of Artificial Sequence: Synthetic peptide
  MOD_RES (1)..(1): Gly, Trp, Val, Ile, Glu, Ser or Asp
  MOD_RES (4)..(4): Asn, His, Tyr, Met, Thr, Phe, Val, Arg, Gln, Ala, Ser, Glu Gly, Cys, Asp or Pro
  MOD_RES (7)..(7): Ser or Tyr
XASXLEX

SEQ ID NO: 3851 - protein, 9 aa, Artificial Sequence
  Description of Artificial Sequence: Synthetic peptide
  MOD_RES (3)..(3): Ser, Cys, Gly, Ile, Trp, Arg, Asn, Ala, Tyr, Lys, Gln or Phe
  MOD_RES (4)..(4): Trp, Cys, Leu, Gly, Glu or Ser
  MOD_RES (5)..(5): Asn, Ile, Thr, Asp, Gly, Met, Ser, His, Ala, Arg, Val, Leu, Phe, Lys or Gln
  MOD_RES (6)..(6): Asp, Asn, Tyr, Ala, Leu, Met, Pro, Gly, His, Phe or Lys
  MOD_RES (8)..(8): Phe, Met, Gly, Tyr, Ala, Trp, Ser, Val, Cys or Pro
QQXXXXPXT

SEQ ID NO: 3852 - protein, 12 aa, Artificial Sequence
  Description of Artificial Sequence: Synthetic peptide
  MOD_RES (3)..(3): Ser, Ile or Arg
  MOD_RES (5)..(5): Ser, Tyr, Ala, Asp, Thr, Met, Arg, Leu, Cys, Phe, Trp or Pro
  MOD_RES (7)..(7): Tyr or Ser
  MOD_RES (8)..(8): Gly or Glu
  MOD_RES (9)..(9): Met or Val
  MOD_RES (10)..(10): Gly, Ser or Arg
  MOD_RES (11)..(11): Val or Ile
  MOD_RES (12)..(12): Gly, Asp, Leu, Ala, Cys, Val, Tyr, Arg, Thr, Glu or Ser
GFXLXTXXXXXX

SEQ ID NO: 3853 - protein, 16 aa, Artificial Sequence
  Description of Artificial Sequence: Synthetic peptide
  MOD_RES (1)..(1): Asn or Leu
  MOD_RES (3)..(3): Trp, Asp, Cys or Gly
  MOD_RES (4)..(4): Trp or Cys
  MOD_RES (5)..(5): Asp, Tyr, Asn, His, Val, Glu, Ile, Pro, Ala, Cys or Gly
  MOD_RES (6)..(6): Asp, Gly, Asn or His
  MOD_RES (7)..(7): Asp, Glu, Gly, Val, Ala, His, Tyr, Asn, Gln, Ser or Leu
  MOD_RES (8)..(8): Lys, Glu, Thr, Ile, Gln, Val, Asn, Arg, Tyr, Leu, Met or Cys
  MOD_RES (9)..(9): Tyr, His, Cys, Asp, Asn, Ser, Ala, Phe or Gly
  MOD_RES (11)..(11): Asn or Ser
  MOD_RES (12)..(12): Pro, Leu or Thr
  MOD_RES (15)..(15): Lys or Asn
  MOD_RES (16)..(16): Asn, Ser or Thr
XIXXXXXXXYXXSLXX

SEQ ID NO: 3854 - protein, 12 aa, Artificial Sequence
  Description of Artificial Sequence: Synthetic peptide
  MOD_RES (1)..(1): Ile, Tyr, Asn, Leu, Met, Val, Arg, Lys, Phe, Cys, Thr or Glu
  MOD_RES (2)..(2): Glu, Gln, Val, Lys, Tyr, Leu, Asp, Gly, Ala, Met, Arg or Ser
  MOD_RES (3)..(3): Ser, Thr, Ala, Tyr, Trp, Pro, Leu, Val, Glu, Lys, Phe or Cys
  MOD_RES (4)..(4): Ile, Gly, Ser, Met, Val, Leu, Phe, Asn, Asp, His, Tyr, Thr, Arg, Gln, Lys, Glu or Pro
  MOD_RES (5)..(5): Gly, Trp, Pro, Phe, Cys, Tyr, Ala, Glu, Leu, Val, Ser, Asp or Arg
  MOD_RES (6)..(6): Thr, Pro, Trp, Arg, Ile, Phe, Ala, Met, Tyr, Ser, Leu, Gly, Asp, Lys, Val, Asn or Glu
  MOD_RES (7)..(7): Thr, Asn, Ser, Lys, Arg, Met, Ala, Glu, Ile, Val, Leu, Trp, Pro or Gln
  MOD_RES (9)..(9): Ser, Glu, Asp, Tyr, Ala, Cys, Asn, Met, Trp, Thr, Gln, Gly, Ile, Leu or Pro
  MOD_RES (11)..(11): Asp or Tyr
XXXXXXXYXFXY

SEQ ID NO: 3855 - protein, 13 aa, Artificial Sequence
  Description of Artificial Sequence: Synthetic peptide
  MOD_RES (1)..(1): Glu, Arg or Lys
  MOD_RES (2)..(2): Arg, Ala or Glu
  MOD_RES (3)..(3): Ser or Tyr
  MOD_RES (5)..(5): Gly, Cys, Val or Ser
  MOD_RES (6)..(6): Asp, Ser or Tyr
  MOD_RES (7)..(7): Ile, Asn, Thr or Met
  MOD_RES (8)..(8): Gly, Trp, Tyr, Ser, Met, His, Asp, Arg, Glu, Asn, Cys, Ala, Leu, Val, Phe, Thr, Gln or Lys
  MOD_RES (9)..(9): Asp, Tyr, Gln, Asn, His, Gly, Glu, Ser, Lys, Phe, Arg, Leu, Cys, Ala or Pro
  MOD_RES (10)..(10): Ser, Thr, Tyr, Met, Lys, Ala, Cys, Phe, Leu, Glu, Trp, Asp, Pro or Gly
  MOD_RES (11)..(11): Tyr, Phe, Leu, Arg, His, Asn, Cys, Ala, Asp, Ser or Thr
  MOD_RES (12)..(12): Val, Phe or Ser
  MOD_RES (13)..(13): Ser or Pro
XXXSXXXXXXXXX

SEQ ID NO: 3856 - protein, 7 aa, Artificial Sequence
  Description of Artificial Sequence: Synthetic peptide
  MOD_RES (1)..(1): Ala, Gly, Ser, Trp, Thr, Leu, Val, Phe, Asn, Pro, Glu or Asp
  MOD_RES (2)..(2): Asp, Tyr, Ala or Val
  MOD_RES (3)..(3): Asp or Gly
  MOD_RES (4)..(4): Gly, Leu, Arg, His, Trp, Tyr, Met, Lys, Asp, Ala, Glu, Asn, Val, Ser, Phe or Pro
  MOD_RES (5)..(5): Arg, Gln or Pro
  MOD_RES (6)..(6): Pro or Ala
  MOD_RES (7)..(7): Ser, Ile, Thr, Arg or Gly
XXXXXXX

SEQ ID NO: 3857 - protein, 10 aa, Artificial Sequence
  Description of Artificial Sequence: Synthetic peptide
  MOD_RES (1)..(1): Gln or Lys
  MOD_RES (2)..(2): Ser, Pro, Gln or His
  MOD_RES (4)..(4): Asp or Gly
  MOD_RES (5)..(5): Ile, Leu, Val, Glu, Thr, Ser, Gln, Arg, Asn, Lys, Gly, Ala, Cys or Phe
  MOD_RES (6)..(6): Asn, Phe, Asp, Glu, Thr, Ile, Tyr, Cys, Val, Ser, Arg, Ala, Leu, Gly, His or Lys
  MOD_RES (7)..(7): Ile, Thr, Ser, Val, Asp, Arg, Glu, Met, Leu, Pro, Phe, Asn or Lys
  MOD_RES (8)..(8): Asp, Asn, Pro, Ala, Tyr, Gly, His, Glu, Val, Leu, Gln or Thr
  MOD_RES (9)..(9): Ile, Val, Leu, Gly, Thr, Ser, Asn, Phe, Ala, His, Arg or Gln
  MOD_RES (10)..(10): Val or Thr
XXYXXXXXXX

SEQ ID NO: 3858 - protein, 10 aa, Artificial Sequence
  Description of Artificial Sequence: Synthetic peptide
GYTFTNYGMY

SEQ ID NO: 3859 - protein, 17 aa, Artificial Sequence
  Description of Artificial Sequence: Synthetic peptide
WINTETGKPTYADDFKG

SEQ ID NO: 3860 - protein, 14 aa, Artificial Sequence
  Description of Artificial Sequence: Synthetic peptide
TNYYYRSYIFYFDY

SEQ ID NO: 3861 - protein, 11 aa, Artificial Sequence
  Description of Artificial Sequence: Synthetic peptide
RASESVSTHMH

SEQ ID NO: 3862 - protein, 7 aa, Artificial Sequence
  Description of Artificial Sequence: Synthetic peptide
GASNLES

SEQ ID NO: 3863 - protein, 9 aa, Artificial Sequence
  Description of Artificial Sequence: Synthetic peptide
QQSWNDPFT

SEQ ID NO: 3864 - protein, 10 aa, Artificial Sequence
  Description of Artificial Sequence: Synthetic peptide
GYTFTNYGMY

SEQ ID NO: 3865 - protein, 17 aa, Artificial Sequence
  Description of Artificial Sequence: Synthetic peptide
WINTETGKPTYADDFKG

SEQ ID NO: 3866 - protein, 14 aa, Artificial Sequence
  Description of Artificial Sequence: Synthetic peptide
TNYYYRSYIFYFDY

SEQ ID NO: 3867 - protein, 11 aa, Artificial Sequence
  Description of Artificial Sequence: Synthetic peptide
RASESVSTHMH

SEQ ID NO: 3868 - protein, 7 aa, Artificial Sequence
  Description of Artificial Sequence: Synthetic peptide
GASNLES

SEQ ID NO: 3869 - protein, 9 aa, Artificial Sequence
  Description of Artificial Sequence: Synthetic peptide
QQSWNDPFT

SEQ ID NO: 3870 - protein, 12 aa, Artificial Sequence
  Description of Artificial Sequence: Synthetic peptide
GFSLSTYGMGVG

SEQ ID NO: 3871 - protein, 16 aa, Artificial Sequence
  Description of Artificial Sequence: Synthetic peptide
NIWWDDDKYYNPSLKN

SEQ ID NO: 3872 - protein, 12 aa, Artificial Sequence
  Description of Artificial Sequence: Synthetic peptide
IESIGTTYSFDY

SEQ ID NO: 3873 - protein, 13 aa, Artificial Sequence
  Description of Artificial Sequence: Synthetic peptide
ERSSGDIGDSYVS

SEQ ID NO: 3874 - protein, 7 aa, Artificial Sequence
  Description of Artificial Sequence: Synthetic peptide
ADDQRPS

SEQ ID NO: 3875 - protein, 10 aa, Artificial Sequence
  Description of Artificial Sequence: Synthetic peptide
QSYDINIDIV

SEQ ID NO: 3876 - protein, 12 aa, Artificial Sequence
  Description of Artificial Sequence: Synthetic peptide
GFSLSTYGMGVG

SEQ ID NO: 3877 - protein, 16 aa, Artificial Sequence
  Description of Artificial Sequence: Synthetic peptide
NIWWDDDKYYNPSLKN

SEQ ID NO: 3878 - protein, 12 aa, Artificial Sequence
  Description of Artificial Sequence: Synthetic peptide
IESIGTTYSFDY

SEQ ID NO: 3879 - protein, 13 aa, Artificial Sequence
  Description of Artificial Sequence: Synthetic peptide
ERSSGDIGDSYVS

SEQ ID NO: 3880 - protein, 7 aa, Artificial Sequence
  Description of Artificial Sequence: Synthetic peptide
ADDQRPS

SEQ ID NO: 3881 - protein, 10 aa, Artificial Sequence
  Description of Artificial Sequence: Synthetic peptide
QSYDINIDIV

SEQ ID NO: 3882 - protein, 123 aa, Artificial Sequence
  Description of Artificial Sequence: Synthetic polypeptide
QVTLRESGPALVKPTQTLTLTCTFSGFSLSTFGMGVGWIRQPPGKALEWLANIWWDDDKYYNPSLKNRLTISKDTSKNQVVLTMTNMDPVDTATYYCARISTGISSYYVMDAWGQGTTVTVSS

SEQ ID NO: 3883 - protein, 123 aa, Artificial Sequence; identical to SEQ ID NO: 1396
  Description of Artificial Sequence: Synthetic polypeptide

SEQ ID NO: 3884 - protein, 123 aa, Artificial Sequence
  Description of Artificial Sequence: Synthetic polypeptide
EVTLRESGPALVKPTQTLTLTCTFSGFSLSTFGMGVGWIRQPPGKGLEWLANIWWDDDKYYNPSLKNRLTISKDTSNNQAVLTITNMDPVDTATYYCARISTGISSYYVMDAWGQGTTVTVSS

SEQ ID NO: 3885 - protein, 123 aa, Artificial Sequence
  Description of Artificial Sequence: Synthetic polypeptide
EVTLRESGPALVKPTQTLTLTCTFSGFSLSTFGMGVGWIRQPPGKGLEWLANIWWDDDKYYNPSLKNRLTISKDTSKNQVVLTITNMDPVDTATYYCARISTGISSYYVMDAWGQGTTVTVSS

SEQ ID NO: 3886 - protein, 123 aa, Artificial Sequence
  Description of Artificial Sequence: Synthetic polypeptide
EVTLRESGPALVKPTQTLTLTCTFSGFSLSTFGMGVGWIRQPPGKGLEWLANIWWDDDKYYNPSLKTRLTISKDTSKNQVVLTITNMDPVDTATYYCARISTGISSYYVMDAWGQGTTVTVSS

SEQ ID NO: 3887 - protein, 123 aa, Artificial Sequence
  Description of Artificial Sequence: Synthetic polypeptide
QVTLKESGPALVKPTQTLTLTCTFSGFSLSTFGMGVGWIRQPPGKALEWLANIWWDDDKYYNPSLKNRLTISKDTSKNQVVLTMTNMDPVDTATYYCARISTGISSYYVMDAWGQGTTVTVSS

SEQ ID NO: 3888 - protein, 123 aa, Artificial Sequence
  Description of Artificial Sequence: Synthetic polypeptide
EVTLKESGPALVKPTQTLTLTCTFSGFSLSTFGMGVGWIRQPPGKALEWLANIWWDDDKYYNPSLKNRLTISKDTSKNQVVLTMTNMDPVDTATYYCARISTGISSYYVMDAWGQGTTVTVSS

SEQ ID NO: 3889 - protein, 123 aa, Artificial Sequence; identical to SEQ ID NO: 1436
  Description of Artificial Sequence: Synthetic polypeptide

SEQ ID NO: 3890 - protein, 123 aa, Artificial Sequence; identical to SEQ ID NO: 1428
  Description of Artificial Sequence: Synthetic polypeptide

SEQ ID NO: 3891 - protein, 123 aa, Artificial Sequence; identical to SEQ ID NO: 3
  Description of Artificial Sequence: Synthetic polypeptide

SEQ ID NO: 3892 - protein, 123 aa, Artificial Sequence; identical to SEQ ID NO: 211
  Description of Artificial Sequence: Synthetic polypeptide

SEQ ID NO: 3893 - protein, 111 aa, Artificial Sequence; identical to SEQ ID NO: 1400
  Description of Artificial Sequence: Synthetic polypeptide

SEQ ID NO: 3894 - protein, 111 aa, Artificial Sequence; identical to SEQ ID NO: 1456
  Description of Artificial Sequence: Synthetic polypeptide

SEQ ID NO: 3895 - protein, 111 aa, Artificial Sequence
  Description of Artificial Sequence: Synthetic polypeptide
QFMLTQPHSVSESPGKTVTIPCERSSGDIGDTYVSWYQQRPGSPPTNVIYGNDQRPSEVSDRFSGSIDSSSNSASLTISGLKTEDEADYFCQSYDSDIDIVFGGGTKLTVL

SEQ ID NO: 3896 - protein, 111 aa, Artificial Sequence
  Description of Artificial Sequence: Synthetic polypeptide
QFMLTQPHSVSESPGKTVTISCERSSGDIGDTYVSWYQQRPGSSPTTVIYGNDQRPSGVPDRFSGSIDSSSNSASLTISGLKTEDEADYFCQSYDSDIDIVFGGGTKLTVL

SEQ ID NO: 3897 - protein, 110 aa, Artificial Sequence; identical to SEQ ID NO: 1464
  Description of Artificial Sequence: Synthetic polypeptide

SEQ ID NO: 3898 - protein, 111 aa, Artificial Sequence
  Description of Artificial Sequence: Synthetic polypeptide
EFVLTQSPGLSLSPGERATLSCERSSGDIGDTYVSWYQQKPGQPPRNVIYGNDQRPSGVPDRFSGSIDSSSNDATLTISRLEPEDFAVYFCQSYDSDIDIVFGGGTKVEIK

SEQ ID NO: 3899 - protein, 110 aa, Artificial Sequence; identical to SEQ ID NO: 1472
  Description of Artificial Sequence: Synthetic polypeptide

SEQ ID NO: 3900 - protein, 110 aa, Artificial Sequence; identical to SEQ ID NO: 1440
  Description of Artificial Sequence: Synthetic polypeptide

SEQ ID NO: 3901 - protein, 110 aa, Artificial Sequence; identical to SEQ ID NO: 4
  Description of Artificial Sequence: Synthetic polypeptide

SEQ ID NO: 3902 - protein, 110 aa, Artificial Sequence; identical to SEQ ID NO: 212
  Description of Artificial Sequence: Synthetic polypeptide

SEQ ID NO: 3903 - protein, 122 aa, Artificial Sequence
  Description of Artificial Sequence: Synthetic polypeptide
QVTLRESGPALVKPTQTLTLTCTFSGFSLSTYGMGVGWIRQPPGKALEWLANIWWDDDKYYNPSLKNRLTISKDTSKNQVVLTMTNMDPVDTATYYCARIESIGTTYSFDYWGQGTMVTVSS

SEQ ID NO: 3904 - protein, 122 aa, Artificial Sequence; identical to SEQ ID NO: 1
  Description of Artificial Sequence: Synthetic polypeptide

SEQ ID NO: 3905 - protein, 122 aa, Artificial Sequence; identical to SEQ ID NO: 1548
  Description of Artificial Sequence: Synthetic polypeptide

SEQ ID NO: 3906 - protein, 122 aa, Artificial Sequence
  Description of Artificial Sequence: Synthetic polypeptide
EVTLRESGPALVKPTQTLTLTCTFSGFSLSTYGMGVGWIRQPPGKGLEWLANIWWDDDKYYNPSLKNRLTISKDTSKNQVVLTITNMDPVDTATYYCARIESIGTTYSFDYWGQGTMVTVSS

SEQ ID NO: 3907 - protein, 122 aa, Artificial Sequence
  Description of Artificial Sequence: Synthetic polypeptide
EVTLRESGPALVKPTQTLTLTCTFSGFSLSTYGMGVGWIRQPPGKGLEWLANIWWDDDKYYNPSLKTRLTISKDTSKNQVVLTITNMDPVDTATYYCARIESIGTTYSFDYWGQGTMVTVSS

SEQ ID NO: 3908 - protein, 122 aa, Artificial Sequence; identical to SEQ ID NO: 7
  Description of Artificial Sequence: Synthetic polypeptide

SEQ ID NO: 3909 - protein, 122 aa, Artificial Sequence; identical to SEQ ID NO: 5
  Description of Artificial Sequence: Synthetic polypeptide

SEQ ID NO: 3910 - protein, 111 aa, Artificial Sequence; identical to SEQ ID NO: 1520
  Description of Artificial Sequence: Synthetic polypeptide

SEQ ID NO: 3911 - protein, 111 aa, Artificial Sequence; identical to SEQ ID NO: 1560
  Description of Artificial Sequence: Synthetic polypeptide

SEQ ID NO: 3912 - protein, 110 aa, Artificial Sequence; identical to SEQ ID NO: 1568
  Description of Artificial Sequence: Synthetic polypeptide

SEQ ID NO: 3913 - protein, 111 aa, Artificial Sequence
  Description of Artificial Sequence: Synthetic polypeptide
EFVLTQSPGLSLSPGERATLSCERSSGDIGDSYVSWYQQKPGQPPRNVIYADDQRPSGVPDRFSGSIDSSGNDATLTISRLEPEDFAVYFCQSYDINIDIVFGGGTKVEIK

SEQ ID NO: 3914 - protein, 110 aa, Artificial Sequence; identical to SEQ ID NO: 2
  Description of Artificial Sequence: Synthetic polypeptide

SEQ ID NO: 3915 - protein, 110 aa, Artificial Sequence; identical to SEQ ID NO: 8
  Description of Artificial Sequence: Synthetic polypeptide

SEQ ID NO: 3916 - protein, 110 aa, Artificial Sequence; identical to SEQ ID NO: 6
  Description of Artificial Sequence: Synthetic polypeptide

SEQ ID NO: 3917 - protein, 120 aa, Artificial Sequence
  Description of Artificial Sequence: Synthetic polypeptide
QVQLVQSGAEVKKPGSSVKVSCKASGYTFTDYAMHWVRQAPGQGLEWMGTIIPLIDTTSYNQKFKGRVTITADESTSTAYMELSSLRSEDTAVYYCARDWDNNWGYFDYWGQGTMVTVSS

SEQ ID NO: 3918 - protein, 120 aa, Artificial Sequence
  Description of Artificial Sequence: Synthetic polypeptide
EVQLVQSGAEVKKPGSSVKVSCKASGYTFTDYAMHWVRQAPGQGLEWMGTIIPLIDTTSYNQKFKGRVTITADESTSTAYMELSSLRSEDTAVYYCARDWDNNWGYFDYWGQGTMVTVSS

SEQ ID NO: 3919 - protein, 120 aa, Artificial Sequence
  Description of Artificial Sequence: Synthetic polypeptide
EVQLVQSGAEVKKPGSSVKVSCKASGYTFTDYAMHWVRQAPGQGLEWIGTIIPLIDTTSYNQKFKGRATLTADTSTNTAYMELSSLRSEDTAVYYCARDWDNNWGYFDYWGQGTMVTVSS

SEQ ID NO: 3920 - protein, 120 aa, Artificial Sequence
  Description of Artificial Sequence: Synthetic polypeptide
EVQLVQSGAEVKKPGSSVKVSCKASGYTFTDYAMHWVRQAPGQGLEWIGTIIPLIDTTSYNQKFKGRVTITADESTSTAYMELSSLRSEDTAVYYCARDWDNNWGYFDYWGQGTMVTVSS

SEQ ID NO: 3921 - protein, 120 aa, Artificial Sequence
  Description of Artificial Sequence: Synthetic polypeptide
EVQLVQSGAEVKKPGSSVKVSCKASGGTFSDYAMHWVRQAPGQGLEWIGTIIPLIDTTSYNQKFKGRVTITADESTSTAYMELSSLRSEDTAVYYCARDWDNNWGYFDYWGQGTMVTVSS

SEQ ID NO: 3922 - protein, 112 aa, Artificial Sequence
  Description of Artificial Sequence: Synthetic polypeptide
DIVMTQTPLSLSVTPGQPASISCRSSQSLEYSDGYTYLEWYLQKPGQSPQLLIYGVSNRFSGVPDRFSGSGSGTDFTLKISRVEAEDVGVYYCFQATHDPLTFGQGTKLEIK

SEQ ID NO: 3923 - protein, 112 aa, Artificial Sequence
  Description of Artificial Sequence: Synthetic polypeptide
DVVLTQTPLSLSVTPGQPASISCRSSQSLEYSDGYTYLEWYLQKPGQSPQLLIYGVSNRFSGVPDRFSGSGSGTDFTLKISRVEAEDVGVYYCFQATHDPLTFGQGTKLEIK

SEQ ID NO: 3924 - protein, 112 aa, Artificial Sequence
  Description of Artificial Sequence: Synthetic polypeptide
DVVMTQTPLSLSVTPGQPASISCRSSQSLEYSDGYTYLEWYLQKPGQSPQLLIYGVSNRFSGVPDRFSGSGSGTDFTLKISRVEAEDVGVYYCFQATHDPLTFGQGTKLEIK

SEQ ID NO: 3925 - protein, 123 aa, Artificial Sequence
  Description of Artificial Sequence: Synthetic polypeptide
QVQLVQSGAEVKKPGSSVKVSCKASGYTFTDYVMHWVRQAPGQGLEWMGTIIPLIDTTSYNQKFKGRVTITADKSTSTAYMELSSLRSEDTAVYYCARTSPYYYSSYDVMDAWGQGTTVTVSS

SEQ ID NO: 3926 - protein, 123 aa, Artificial Sequence; identical to SEQ ID NO: 1300
  Description of Artificial Sequence: Synthetic polypeptide

SEQ ID NO: 3927 - protein, 123 aa, Artificial Sequence; identical to SEQ ID NO: 1356
  Description of Artificial Sequence: Synthetic polypeptide

SEQ ID NO: 3928 - protein, 123 aa, Artificial Sequence; identical to SEQ ID NO: 1308
  Description of Artificial Sequence: Synthetic polypeptide

SEQ ID NO: 3929 - protein, 106 aa, Artificial Sequence; identical to SEQ ID NO: 1304
  Description of Artificial Sequence: Synthetic polypeptide

SEQ ID NO: 3930 - protein, 106 aa, Artificial Sequence; identical to SEQ ID NO: 1312
  Description of Artificial Sequence: Synthetic polypeptide

SEQ ID NO: 3931 - protein, 106 aa, Artificial Sequence; identical to SEQ ID NO: 1320
  Description of Artificial Sequence: Synthetic polypeptide

SEQ ID NO: 3932 - protein, 106 aa, Artificial Sequence; identical to SEQ ID NO: 1328
  Description of Artificial Sequence: Synthetic polypeptide

SEQ ID NO: 3933 - protein, 124 aa, Artificial Sequence
  Description of Artificial Sequence: Synthetic polypeptide
EVQLVESGGGLVQPGGSLRLSCAASGFSFSDSAMAWVRQAPGKGLEWVATIIYDGSGTYYRDSVKGRFTISRDNAKNSLYLQMNSLRAEDTAVYYCARLGFNYGNYGYYVMDAWGQGTTVTVSS

SEQ ID NO: 3934 - protein, 124 aa, Artificial Sequence
  Description of Artificial Sequence: Synthetic polypeptide
EVQLVESGGGLVQPGGSLRLSCAASGFSFSDSAMAWVRQAPGKGLEWVATIIYDGSGTYYRDSVKGRFTISRDNAKSSLYLQMNSLRAEDTAVYYCARLGFNYGNYGYYVMDAWGQGTTVTVSS

SEQ ID NO: 3935 - protein, 124 aa, Artificial Sequence
  Description of Artificial Sequence: Synthetic polypeptide
EVQLVESGGGLVQPGGSLRLSCAASGFTFSDSAMAWVRQAPGKGLEWVATIIYDGSGTYYVDSVKGRFTISRDNAKNSLYLQMNSLRAEDTAVYYCARLGFNYGNYGYYVMDAWGQGTTVTVSS

SEQ ID NO: 3936 - protein, 124 aa, Artificial Sequence
  Description of Artificial Sequence: Synthetic polypeptide
QVQLVQSGAEVKKPGASVKVSCKASGFSFSDSAMAWVRQAPGQRLEWMGTIIYDGSGTYYRDSVKGRVTITRDTSASTAYMELSSLRSEDTAVYYCARLGFNYGNYGYYVMDAWGQGTTVTVSS

SEQ ID NO: 3937 - protein, 124 aa, Artificial Sequence
  Description of Artificial Sequence: Synthetic polypeptide
EVQLVQSGAEVKKPGASVKVSCKASGFSFSDSAMAWVRQAPGQRLEWMGTIIYDGSGTYYRDSVKGRVTITRDTSASTAYMELSSLRSEDTAVYYCARLGFNYGNYGYYVMDAWGQGTTVTVSS

SEQ ID NO: 3938 - protein, 124 aa, Artificial Sequence
  Description of Artificial Sequence: Synthetic polypeptide
EVQLVQSGAEVKKPGASVKVSCKASGFSFSDSAMAWVRQAPGQGLEWVATIIYDGSGTYYRDSVKGRFTITRDNSASTLYLELSSLRSEDTAVYYCARLGFNYGNYGYYVMDAWGQGTTVTVSS

SEQ ID NO: 3939 - protein, 124 aa, Artificial Sequence
  Description of Artificial Sequence: Synthetic polypeptide
EVQLVQSGAEVKKPGASVKVSCKASGFSFSDSAMAWVRQAPGQGLEWVGTIIYDGSGTYYRDSVKGRVTITRDTSASTAYLELSSLRSEDTAVYYCARLGFNYGNYGYYVMDAWGQGTTVTVSS

SEQ ID NO: 3940 - protein, 113 aa, Artificial Sequence
  Description of Artificial Sequence: Synthetic polypeptide
NFMLTQPHSVSESPGKTVTISCERSSGDIGDSYVSWYQQRPGSSPTTVIYADDQRPSGVPDRFSGSIDSSSNSASLTISGLKTEDEADYYCQSYDSNIDINIVFGGGTKLTVL

SEQ ID NO: 3941 - protein, 113 aa, Artificial Sequence
  Description of Artificial Sequence: Synthetic polypeptide
NFMLTQPHSVSESPGKTVTISCERSSGDIGDSYVSWYQQRPGSPPTNVIFADDQRPSGVPDRFSGSIDSSSNSASLTISGLKTEDEADYFCQSYDSNIDINIVFGGGTKLTVL

SEQ ID NO: 3942 - protein, 113 aa, Artificial Sequence
  Description of Artificial Sequence: Synthetic polypeptide
NFMLTQPHSVSESPGKTVTISCERSSGDIGDSYVSWYQQRPGSSPTTVIFADDQRPSGVPDRFSGSIDSSSNSASLTISGLKTEDEADYYCQSYDSNIDINIVFGGGTKLTVL

SEQ ID NO: 3943 - protein, 121 aa, Artificial Sequence
  Description of Artificial Sequence: Synthetic polypeptide
QVQLVQSGAEVKKPGSSVKVSCKASGYTFTESYMYWVRQAPGQGLEWMGRIDPEDGSTDYVEKFKNRVTITADESTSTAYMELSSLRSEDTAVYYCARFGARSYFYPMDAWGQGTTVTVSS

SEQ ID NO: 3944 - protein, 121 aa, Artificial Sequence
  Description of Artificial Sequence: Synthetic polypeptide
EVQLVQSGAEVKKPGSSVKVSCKASGYTFTESYMYWVRQAPGQGLEWMGRIDPEDGSTDYVEKFKNRVTITADESTSTAYMELSSLRSEDTAVYYCARFGARSYFYPMDAWGQGTTVTVSS

SEQ ID NO: 3945 - protein, 121 aa, Artificial Sequence; identical to SEQ ID NO: 13
  Description of Artificial Sequence: Synthetic polypeptide

SEQ ID NO: 3946 - protein, 121 aa, Artificial Sequence
  Description of Artificial Sequence: Synthetic polypeptide
EVQLVQSGAEVKKPGSSVKVSCKASGYTFTESYMYWVRQAPGQGLELIGRIDPEDGSTDYVEKFKNRVTLTADESTSTAYMELSSLRSEDTAVYYCARFGARSYFYPMDAWGQGTTVTVSS

SEQ ID NO: 3947 - protein, 121 aa, Artificial Sequence
  Description of Artificial Sequence: Synthetic polypeptide
EVQLVQSGAEVKKPGSSVKVSCKASGYTFTESYMYWVRQAPGQGLELIGRIDPEDGSTDYVEKFKNRVTITADESTSTAYMELSSLRSEDTAVYYCARFGARSYFYPMDAWGQGTTVTVSS

SEQ ID NO: 3948 - protein, 121 aa, Artificial Sequence
  Description of Artificial Sequence: Synthetic polypeptide
EVQLVQSGAEVKKPGSSVKVSCKASGYTFTESYMYWVKQAPGQSLELIGRIDPEDGSTDYVEKFKNKATLTADESTNTAYMELSSLRSEDTAVYFCARFGARSYFYPMDAWGQGTTVTVSS

SEQ ID NO: 3949 - protein, 107 aa, Artificial Sequence
  Description of Artificial Sequence: Synthetic polypeptide
EIVLTQSPATLSLSPGERATLSCRASESVSTLMHWYQQKPGQAPRLLIYGASNLESGIPARFSGSGSGTDFTLTISSLEPEDFAVYYCQQSWNDPWTFGGGTKVEIK

SEQ ID NO: 3950 - protein, 107 aa, Artificial Sequence; identical to SEQ ID NO: 14
  Description of Artificial Sequence: Synthetic polypeptide

SEQ ID NO: 3951 - protein, 107 aa, Artificial Sequence
  Description of Artificial Sequence: Synthetic polypeptide
ETVLTQSPATLSLSPGERATLSCRASESVSTLMHWYQQKPGQAPRLLIYGASNLESGVPARFSGSGSGTDFTLTISSLEPEDFAVYFCQQSWNDPWTFGGGTKVEIK

SEQ ID NO: 3952 - protein, 107 aa, Artificial Sequence
  Description of Artificial Sequence: Synthetic polypeptide
ETVLTQSPATLSLSPGERATLSCRASESVSTLMHWYQQKPGQAPRLLIYGASNLESGIPARFSGSGSGTDFTLTISSLEPEDFAVYYCQQSWNDPWTFGGGTKVEIK

SEQ ID NO: 3953 - protein, 107 aa, Artificial Sequence
  Description of Artificial Sequence: Synthetic polypeptide
AIQLTQSPSSLSASVGDRVTITCRASESVSTLMHWYQQKPGKAPKLLIYGASNLESGVPSRFSGSGSGTDFTLTISSLQPEDFATYYCQQSWNDPWTFGGGTKVEIK

SEQ ID NO: 3954 - protein, 107 aa, Artificial Sequence; identical to SEQ ID NO: 1648
  Description of Artificial Sequence: Synthetic polypeptide

SEQ ID NO: 3955 - protein, 107 aa, Artificial Sequence
  Description of Artificial Sequence: Synthetic polypeptide
ATQLTQSPSSLSASVGDRVTITCRASESVSTLMHWYQQKPGKAPRLLIYGASNLESGVPSRFSGSGSGTDFTLTISSLQPEDFATYFCQQSWNDPWTFGGGTKVEIK

SEQ ID NO: 3956 - protein, 107 aa, Artificial Sequence
  Description of Artificial Sequence: Synthetic polypeptide
ATQLTQSPSSLSASVGDRVTITCRASESVSTLMHWYQQKPGKAPRLLIYGASNLESGVPSRFSGSGSGTDFTLTISSLQPEDFATYYCQQSWNDPWTFGGGTKVEIK

SEQ ID NO: 3957 - protein, 121 aa, Artificial Sequence
  Description of Artificial Sequence: Synthetic polypeptide
QVQLVQSGAEVKKPGSSVKVSCKASGYTFTESYIYWVRQAPGQGLEWMGRIDPEDGSTDYVEKFKNRVTITADESTSTAYMELSSLRSEDTAVYYCARFGARSYFYPMDAWGQGTTVTVSS

SEQ ID NO: 3958 - protein, 121 aa, Artificial Sequence
  Description of Artificial Sequence: Synthetic polypeptide
EVQLVQSGAEVKKPGSSVKVSCKASGYTFTESYIYWVRQAPGQGLEWMGRIDPEDGSTDYVEKFKNRVTITADESTSTAYMELSSLRSEDTAVYYCARFGARSYFYPMDAWGQGTTVTVSS

SEQ ID NO: 3959 - protein, 121 aa, Artificial Sequence
  Description of Artificial Sequence: Synthetic polypeptide
EVQLVQSGAEVKKPGSSVKVSCKASGYTFTESYIYWVKQAPGQGLELIGRIDPEDGSTDYVEKFKNKATLTADESTNTAYMELSSLRSEDTAVYFCARFGARSYFYPMDAWGQGTTVTVSS

SEQ ID NO: 3960 - protein, 121 aa, Artificial Sequence
  Description of Artificial Sequence: Synthetic polypeptide
EVQLVQSGAEVKKPGSSVKVSCKASGYTFTESYIYWVRQAPGQGLELIGRIDPEDGSTDYVEKFKNRVTLTADESTNTAYMELSSLRSEDTAVYYCARFGARSYFYPMDAWGQGTTVTVSS

SEQ ID NO: 3961 - protein, 121 aa, Artificial Sequence
  Description of Artificial Sequence: Synthetic polypeptide
EVQLVQSGAEVKKPGSSVKVSCKASGYTFTESYIYWVRQAPGQGLELIGRIDPEDGSTDYVEKFKNRVTITADESTSTAYMELSSLRSEDTAVYYCARFGARSYFYPMDAWGQGTTVTVSS

SEQ ID NO: 3962 - protein, 107 aa, Artificial Sequence; identical to SEQ ID NO: 3949
  Description of Artificial Sequence: Synthetic polypeptide

SEQ ID NO: 3963 - protein, 107 aa, Artificial Sequence
  Description of Artificial Sequence: Synthetic polypeptide
ETVLTQSPATLSLSPGERATLPCRASESVSTLMHWYQQKPGQQPRLLIYGASNLESGVPARFSGSGSGTDFTLTISSLEPEDFAVYFCQQSWNDPWTFGGGTKVEIK

SEQ ID NO: 3964 - protein, 107 aa, Artificial Sequence; identical to SEQ ID NO: 3951
  Description of Artificial Sequence: Synthetic polypeptide

SEQ ID NO: 3965 - protein, 107 aa, Artificial Sequence; identical to SEQ ID NO: 3952
  Description of Artificial Sequence: Synthetic polypeptide

SEQ ID NO: 3966 - protein, 107 aa, Artificial Sequence
  Description of Artificial Sequence: Synthetic polypeptide
DIQMTQSPSTLSASVGDRVTITCRASESVSTLMHWYQQKPGKAPKLLIYGASNLESGVPSRFSGSGSGTEFTLTISSLQPDDFATYYCQQSWNDPWTFGGGTKVEIK

SEQ ID NO: 3967 - protein, 107 aa, Artificial Sequence
  Description of Artificial Sequence: Synthetic polypeptide
DTQLTQSPSTLSASVGDRVTIPCRASESVSTLMHWYQQKPGKQPKLLIYGASNLESGVPSRFSGSGSGTEFTLTISSLQPDDFATYFCQQSWNDPWTFGGGTKVEIK

SEQ ID NO: 3968 - protein, 107 aa, Artificial Sequence
  Description of Artificial Sequence: Synthetic polypeptide
DTQLTQSPSTLSASVGDRVTITCRASESVSTLMHWYQQKPGKAPKLLIYGASNLESGVPSRFSGSGSGTEFTLTISSLQPDDFATYFCQQSWNDPWTFGGGTKVEIK

SEQ ID NO: 3969 - protein, 107 aa, Artificial Sequence
  Description of Artificial Sequence: Synthetic polypeptide
DTQMTQSPSTLSASVGDRVTITCRASESVSTLMHWYQQKPGKAPKLLIYGASNLESGVPSRFSGSGSGTEFTLTISSLQPDDFATYYCQQSWNDPWTFGGGTKVEIK

We claim:

1. An antibody or antigen binding fragment thereof capable of binding platelet-derived growth factor (PDGF), wherein the antibody or antigen binding fragment comprises CDRs 1-3 from SEQ ID NO: 15 and CDRs-1-3 from SEQ ID NO: 16.

2. The antibody or antigen binding fragment of claim 1, wherein the antibody or antigen binding fragment comprises SEQ ID NO: 15 and SEQ ID NO: 16.

3. The antibody or antigen binding fragment of claim 1, further comprising heavy and light chain constant domains selected from Table 3.

4. The antibody or antigen binding fragment of claim 1, further comprising:

a) a heavy chain constant region on the first polypeptide chain comprising a human IgG1 heavy chain sequence modified by substitution of leucines at positions 234 and 235 with alanines, and optionally also comprises a substitution of histidine at position 435 with alanine, wherein the amino acid positions are numbered using EU index numbering; and (b) a light chain constant region on the second polypeptide chain comprising a human kappa light chain constant region sequence.

5. An antibody or antigen binding fragment that competes with the antibody or antigen binding fragment of claim 1 for binding to PDGF.

6. An antibody or antigen binding fragment that binds to the same epitope of PDGF as the antibody or antigen binding fragment of claim 1.

7. An antibody conjugate comprising the antibody or antigen binding fragment of claim 1, the antibody conjugate further comprising an immunoadhesion molecule, an imaging agent, a therapeutic agent, or a cytotoxic agent, wherein the imaging agent is a radiolabel, an enzyme, a fluorescent label, a luminescent label, a bioluminescent label, a magnetic label, or biotin, wherein the radiolabel is $^{3}$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm, and wherein the therapeutic or cytotoxic agent is an anti-metabolite, an alkylating agent, an antibiotic, a growth factor, a cytokine, an anti-angiogenic agent, an anti-mitotic agent, an anthracycline, toxin, or an apoptotic agent.

8. A pharmaceutical composition comprising the antibody or antigen binding fragment of claim 1, and a pharmaceutically acceptable carrier.

9. The pharmaceutical composition of claim 8, further comprising at least one additional therapeutic agent.

\* \* \* \* \*